US011866751B2

United States Patent
Catlett et al.

(10) Patent No.: US 11,866,751 B2
(45) Date of Patent: Jan. 9, 2024

(54) YEAST EXPRESSING A HETEROLOGOUS ALPHA-AMYLASE FOR ETHANOL PRODUCTION

(71) Applicant: Novozymes A/S, Bagsvaerd (DK)

(72) Inventors: Michael Glenn Catlett, West Sacramento, CA (US); Monica Tassone, West Sacramento, CA (US); Paul Vincent Harris, Carnation, WA (US); Robert Lyle Osborne, Raleigh, NC (US); Ryoko Kataoka, Longmont, CO (US); Shiro Fukuyama, Chiba (JP); Tomoko Matsui, Chiba (JP)

(73) Assignee: Novozymes A/S, Bagsvaerd (DK)

( * ) Notice: Subject to any disclaimer, the term of this patent is extended or adjusted under 35 U.S.C. 154(b) by 19 days.

(21) Appl. No.: 17/260,516

(22) PCT Filed: Jul. 22, 2019

(86) PCT No.: PCT/US2019/042870
§ 371 (c)(1),
(2) Date: Jan. 14, 2021

(87) PCT Pub. No.: WO2020/023411
PCT Pub. Date: Jan. 30, 2020

(65) Prior Publication Data
US 2021/0261988 A1 Aug. 26, 2021

Related U.S. Application Data

(60) Provisional application No. 62/703,103, filed on Jul. 25, 2018.

(51) Int. Cl.
*C12P 7/06* (2006.01)

(52) U.S. Cl.
CPC .............. *C12P 7/06* (2013.01); *C12P 2203/00* (2013.01); *C12Y 302/01001* (2013.01); *C12Y 302/01093* (2013.01)

(58) Field of Classification Search
None
See application file for complete search history.

(56) References Cited

U.S. PATENT DOCUMENTS

| | | | |
|---|---|---|---|
| 8,076,109 B2 * | 12/2011 | Allain | C12P 7/06 |
| | | | 435/71.1 |
| 9,206,444 B2 | 12/2015 | Brevnova et al. | |
| 2018/0155744 A1 | 6/2018 | Cripwell et al. | |

FOREIGN PATENT DOCUMENTS

| | | |
|---|---|---|
| WO | 2011049945 A2 | 4/2011 |
| WO | 2011128712 A1 | 10/2011 |
| WO | 2011153516 A2 | 12/2011 |
| WO | 2015065781 A1 | 5/2015 |
| WO | 2016205127 A1 | 12/2016 |
| WO | 2017037614 A1 | 3/2017 |
| WO | 2017077504 A1 | 5/2017 |
| WO | 2017087330 A1 | 5/2017 |
| WO | 2018098381 A1 | 5/2018 |
| WO | 2018222990 A1 | 6/2018 |

OTHER PUBLICATIONS

Chica et al. Curr Opin Biotechnol. Aug. 2005;16(4):378-84. (Year: 2005).*
Singh et al. Curr Protein Pept Sci. 2017, 18, 1-11 (Year: 2017).*
Accession A0A1F7ZUG0. Feb. 15, 2017 (Year: 2017).*
Alignment Seq ID No. 41 of U.S. Pat. No. 8,076,109 to Seq ID No. 126126 (Year: 2011).*
Haan et al, 2013, J Chem Tech Biotechnol 88, 983-991.
Matsuura et al., J. Biochem., 1984, 697-702, 95(3).

* cited by examiner

*Primary Examiner* — Christian L Fronda
(74) *Attorney, Agent, or Firm* — Eric J. Fechter

(57) ABSTRACT

Described herein are recombinant fermenting organisms having a heterologous polynucleotide encoding an alpha-amylase and/or a heterologous polynucleotide encoding a trehalase. Also described are processes for producing a fermentation product, such as ethanol, from starch or cellulosic-containing material with the recombinant fermenting organisms.

20 Claims, 3 Drawing Sheets

Specification includes a Sequence Listing.

YEAST EXPRESSING A HETEROLOGOUS ALPHA-AMYLASE FOR ETHANOL PRODUCTION

CROSS-REFERENCE TO RELATED APPLICATIONS

This application is a 35 U.S.C. 371 national application of PCT/US2019/042870, filed Jul. 22, 2019, which claims priority or the benefit from U.S. Provisional Application Ser. No. 62/703,103, filed Jul. 25, 2018. The contents of these applications are fully incorporated herein by reference.

REFERENCE TO A SEQUENCE LISTING

This application contains a Sequence Listing that was submitted as an ASCII text file named SQ_ST25.txt (created on Jul. 22, 2019, containing 1 MB), which is incorporated herein by reference.

BACKGROUND

Production of ethanol from starch and cellulosic containing materials is well-known in the art.

The most commonly industrially used commercial process for starch-containing material, often referred to as a "conventional process", includes liquefying gelatinized starch at high temperature (about 85° C.) using typically a bacterial alpha-amylase, followed by simultaneous saccharification and fermentation (SSF) carried out anaerobically in the presence of typically a glucoamylase and a *Saccharomyces cerevisae* yeast.

Yeasts which are used for production of ethanol for use as fuel, such as in the corn ethanol industry, require several characteristics to ensure cost effective production of the ethanol. These characteristics include ethanol tolerance, low by-product yield, rapid fermentation, and the ability to limit the amount of residual sugars remaining in the ferment. Such characteristics have a marked effect on the viability of the industrial process.

Yeast of the genus *Saccharomyces* exhibits many of the characteristics required for production of ethanol. In particular, strains of *Saccharomyces cerevisiae* are widely used for the production of ethanol in the fuel ethanol industry. Strains of *Saccharomyces cerevisiae* that are widely used in the fuel ethanol industry have the ability to produce high yields of ethanol under fermentation conditions found in, for example, the fermentation of corn mash. An example of such a strain is the yeast used in commercially available ethanol yeast product called ETHANOL RED®.

*Saccharomyces cerevisae* yeast have been genetically engineered to express alpha-amylase and/or glucoamylase to improve yield and decrease the amount of exogenously added enzymes necessary during SSF (e.g., WO2018/098381, WO2017/087330, WO2017/037614, WO2011/128712, WO2011/153516, US2018/0155744). Yeast have also been engineered to express trehalase in an attempt to increase fermentation yield by breaking down residual trehalose (e.g., WO2017/077504).

Despite significant improvement of ethanol production processes over the past decade there is still a desire and need for providing improved processes of ethanol fermentation from starch and cellulosic containing material in an economically and commercially relevant scale.

SUMMARY

Described herein are, inter alia, methods for producing a fermentation product, such as ethanol, from starch or cellulosic-containing material, and yeast suitable for use in such processes. The Applicant has surprisingly found that yeast expressing certain alpha-amylases and/or trehalases provide beneficial properties that may be useful for ethanol fermentation.

A first aspect relates to methods of producing a fermentation product from a starch-containing or cellulosic-containing material comprising: (a) saccharifying the starch-containing or cellulosic-containing material; and (b) fermenting the saccharified material of step (a) with a fermenting organism; wherein the fermenting organism comprises a heterologous polynucleotide encoding an alpha-amylase or a heterologous polynucleotide encoding a trehalase.

In some embodiments of the methods, fermentation and saccharification are performed simultaneously in a simultaneous saccharification and fermentation (SSF). In other embodiments, fermentation and saccharification are performed sequentially (SHF).

In some embodiments of the methods, the method comprises recovering the fermentation product from the from the fermentation (e.g., by distillation).

In some embodiments of the methods, the fermentation product is ethanol.

In some embodiments of the methods, fermentation is performed under reduced nitrogen conditions (e.g., less than 1000 ppm urea or ammonium hydroxide, such as less than 750 ppm, less than 500 ppm, less than 400 ppm, less than 300 ppm, less than 250 ppm, less than 200 ppm, less than 150 ppm, less than 100 ppm, less than 75 ppm, less than 50 ppm, less than 25 ppm, or less than 10 ppm).

In some embodiments of the methods, the alpha-amylase has a mature polypeptide sequence with 60%, e.g., at least 65%, 70%, 75%, 80%, 85%, 90%, 95%, 97%, 98%, 99%, or 100% sequence identity, to the amino acid sequence of any one of SEQ ID NOs: 76-101, 121-174 and 231. In some embodiments of the methods, the heterologous polynucleotide encodes an alpha-amylase having a mature polypeptide sequence that differs by no more than ten amino acids, e.g., by no more than five amino acids, by no more than four amino acids, by no more than three amino acids, by no more than two amino acids, or by one amino acid from the amino acid sequence of any one of SEQ ID NOs: 76-101, 121-174 and 231. In some embodiments of the methods, the heterologous polynucleotide encodes an alpha-amylase having a mature polypeptide sequence comprising or consisting of the amino acid sequence of any one of SEQ ID NOs: SEQ ID NOs: 76-101, 121-174 and 231.

In some embodiments of the methods, the trehalase has mature polypeptide sequence with 60%, e.g., at least 65%, 70%, 75%, 80%, 85%, 90%, 95%, 97%, 98%, 99%, or 100% sequence identity, to the amino acid sequence of any one of SEQ ID NOs: 175-226. In some embodiments of the methods, the heterologous polynucleotide encodes a trehalase having a mature polypeptide sequence that differs by no more than ten amino acids, e.g., by no more than five amino acids, by no more than four amino acids, by no more than three amino acids, by no more than two amino acids, or by one amino acid from the amino acid sequence of any one of SEQ ID NOs: 175-226. In some embodiments of the methods, the heterologous polynucleotide encodes a trehalase having a mature polypeptide sequence comprising or consisting of the amino acid sequence of any one of SEQ ID NOs: SEQ ID NOs: 175-226.

In some embodiments of the methods, saccharification of step (a) occurs on a starch-containing material, and wherein the starch-containing material is either gelatinized or ungelatinized starch.

In some embodiments of the methods, the method comprises liquefying the starch-containing material by contacting the material with an alpha-amylase prior to saccharification.

In some embodiments of the methods, liquefying the starch-containing material and/or saccharifying the starch-containing material is conducted in presence of exogenously added protease.

In some embodiments of the methods, the fermenting organism comprises a heterologous polynucleotide encoding a glucoamylase, such as a glucoamylase having a mature polypeptide sequence with 60%, e.g., at least 65%, 70%, 75%, 80%, 85%, 90%, 95%, 97%, 98%, 99%, or 100% sequence identity, to the amino acid sequence of a *Pycnoporus glycoamylase* (e.g., a *Pycnoporus sanguineus* glucoamylase of SEQ ID NO: 229), a *Gloeophyllum* glucoamylase (e.g. a *Gloeophyllum sepiarium* of SEQ ID NO: 8), or a glucoamylase of any one of SEQ ID NOs: 102-113 (e.g., a *Saccharomycopsis fibuligera* glucoamylase of SEQ ID NO: 103 or 104, or a *Trichoderma reesei* glucoamylase of SEQ ID NO: 230).

In some embodiments of the methods, the fermenting organism comprises a heterologous polynucleotide encoding a protease, such as a protease having a mature polypeptide sequence of at least 60%, e.g., at least 65%, 70%, 75%, 80%, 85%, 90%, 95%, 97%, 98%, 99%, or 100% sequence identity to the amino acid sequence of any one of SEQ ID NOs: 9-73 (e.g., any one of SEQ ID NOs: 9, 14, 16, 21, 22, 33, 41, 45, 61, 62, 66, 67, and 69; such as any one of SEQ NOs: 9, 14, 16, and 69).

In some embodiments of the methods, saccharification of step (a) occurs on a cellulosic-containing material, and wherein the cellulosic-containing material is pretreated (e.g. a dilute acid pretreatment).

In some embodiments of the methods, saccharification occurs on a cellulosic-containing material, and wherein the enzyme composition comprises one or more enzymes selected from a cellulase (e.g., endoglucanase, a cellobiohydrolase, or a beta-glucosidase), an AA9 polypeptide, a hemicellulase (e.g., a xylanase, an acetylxylan esterase, a feruloyl esterase, an arabinofuranosidase, a xylosidase, or a glucuronidase), a CIP, an esterase, an expansin, a ligninolytic enzyme, an oxidoreductase, a pectinase, a protease, and a swollenin.

In some embodiments of the methods, the fermenting organism is a *Saccharomyces, Rhodotorula, Schizosaccharomyces, Kluyveromyces, Pichia, Hansenula, Rhodosporidium, Candida, Yarrowia, Lipomyces, Cryptococcus,* or *Dekkera* sp. cell. In some embodiments, the fermenting organism is a *Saccharomyces cerevisiae* cell.

Another aspect relates to a recombinant yeast cell comprising a heterologous polynucleotide encoding an alpha-amylase or a heterologous polynucleotide encoding a trehalase.

In some embodiments, the recombinant yeast cell is a *Saccharomyces, Rhodotorula, Schizosaccharomyces, Kluyveromyces, Pichia, Hansenula, Rhodosporidium, Candida, Yarrowia, Lipomyces, Cryptococcus,* or *Dekkera* sp. cell. In some embodiments, the recombinant yeast cell is a *Saccharomyces cerevisiae* cell.

In some embodiments of the yeast cell, the alpha-amylase has a mature polypeptide sequence with 60%, e.g., at least 65%, 70%, 75%, 80%, 85%, 90%, 95%, 97%, 98%, 99%, or 100% sequence identity, to the amino acid sequence of any one of SEQ ID NOs: 76-101, 121-174 and 231. In some embodiments of the methods, the heterologous polynucleotide encodes an alpha-amylase having a mature polypeptide sequence that differs by no more than ten amino acids, e.g., by no more than five amino acids, by no more than four amino acids, by no more than three amino acids, by no more than two amino acids, or by one amino acid from the amino acid sequence of any one of SEQ ID NOs: 76-101, 121-174 and 231. In some embodiments of the methods, the heterologous polynucleotide encodes an alpha-amylase having a mature polypeptide sequence comprising or consisting of the amino acid sequence of any one of SEQ ID NOs: SEQ ID NOs: 76-101, 121-174 and 231.

In some embodiments of the yeast cell, the trehalase has mature polypeptide sequence with 60%, e.g., at least 65%, 70%, 75%, 80%, 85%, 90%, 95%, 97%, 98%, 99%, or 100% sequence identity, to the amino acid sequence of any one of SEQ ID NOs: 175-226. In some embodiments of the methods, the heterologous polynucleotide encodes a trehalase having a mature polypeptide sequence that differs by no more than ten amino acids, e.g., by no more than five amino acids, by no more than four amino acids, by no more than three amino acids, by no more than two amino acids, or by one amino acid from the amino acid sequence of any one of SEQ ID NOs: 175-226. In some embodiments of the methods, the heterologous polynucleotide encodes a trehalase having a mature polypeptide sequence comprising or consisting of the amino acid sequence of any one of SEQ ID NOs: SEQ ID NOs: 175-226.

In some embodiments of the yeast cell, the fermenting organism comprises a heterologous polynucleotide encoding a glucoamylase, such as a glucoamylase having a mature polypeptide sequence with 60%, e.g., at least 65%, 70%, 75%, 80%, 85%, 90%, 95%, 97%, 98%, 99%, or 100% sequence identity, to the amino acid sequence of a *Pycnoporus glycoamylase* (e.g., a *Pycnoporus sanguineus* glucoamylase of SEQ ID NO: 229), a *Gloeophyllum* glucoamylase (e.g. a *Gloeophyllum sepiarium* of SEQ ID NO: 8), or a glucoamylase of any one of SEQ ID NOs: 102-113 (e.g., a *Saccharomycopsis fibuligera* glucoamylase of SEQ ID NO: 103 or 104, or a *Trichoderma reesei* glucoamylase of SEQ ID NO: 230).

In some embodiments of the yeast cell, the fermenting organism comprises a heterologous polynucleotide encoding a protease, such as a protease having a mature polypeptide sequence of at least 60%, e.g., at least 65%, 70%, 75%, 80%, 85%, 90%, 95%, 97%, 98%, 99%, or 100% sequence identity to the amino acid sequence of any one of SEQ ID NOs: 9-73 (e.g., any one of SEQ ID NOs: 9, 14, 16, 21, 22, 33, 41, 45, 61, 62, 66, 67, and 69; such as any one of SEQ NOs: 9, 14, 16, and 69).

DEFINITIONS

Figure 1:
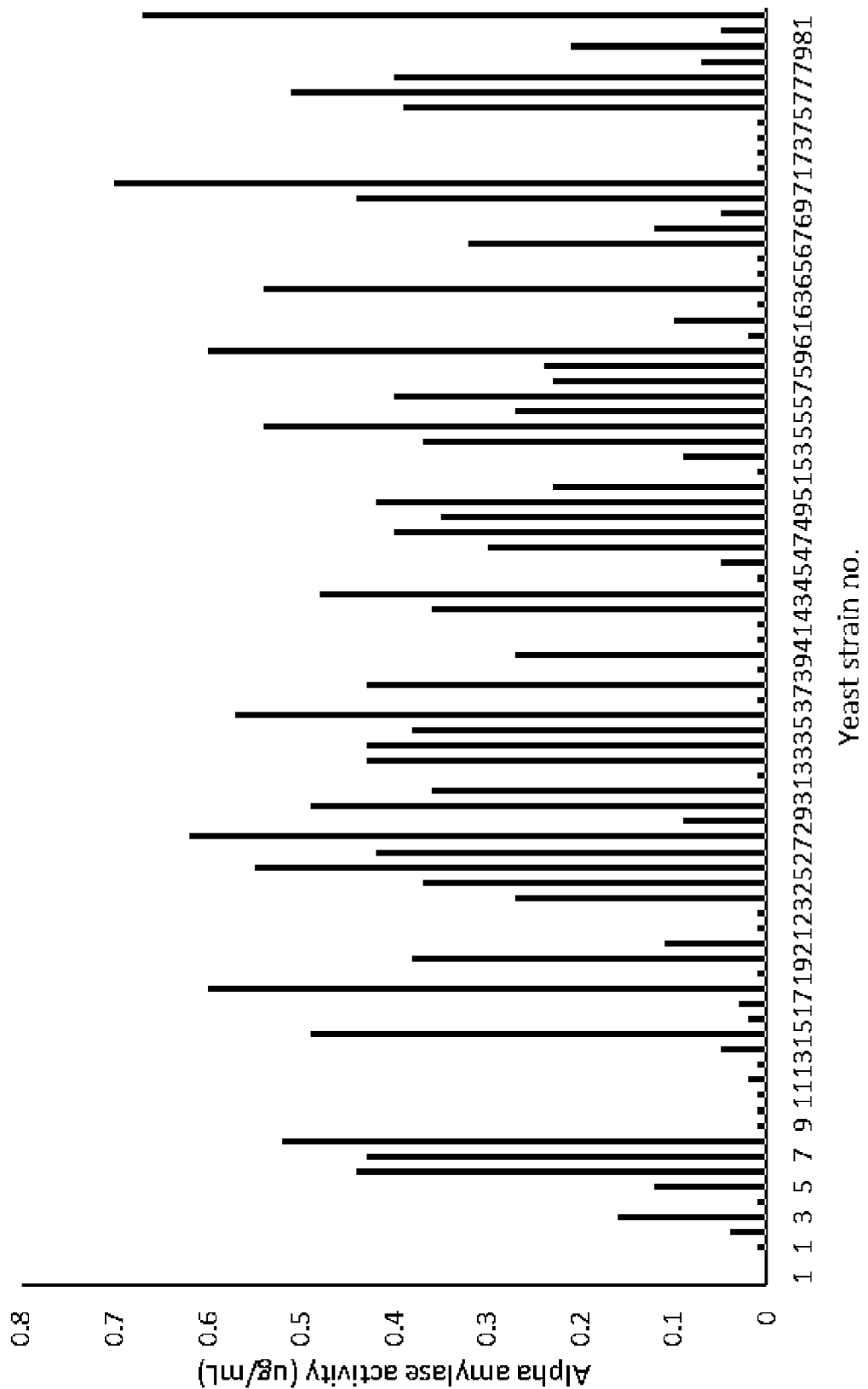
FIG. 1 shows alpha-amylase activity for strains constructed in Example 1.

Unless defined otherwise or clearly indicated by context, all technical and scientific terms used herein have the same meaning as commonly understood by one of ordinary skill in the art.

Allelic variant: The term "allelic variant" means any of two or more alternative forms of a gene occupying the same chromosomal locus. Allelic variation arises naturally through mutation, and may result in polymorphism within populations. Gene mutations can be silent (no change in the encoded polypeptide) or may encode polypeptides having altered amino acid sequences. An allelic variant of a polypeptide is a polypeptide encoded by an allelic variant of a gene.

Alpha-amylase: The term "alpha amylase" means an 1,4-alpha-D-glucan glucanohydrolase, EC. 3.2.1.1, which catalyze hydrolysis of starch and other linear and branched 1,4-glucosidic oligo- and polysaccharides. For purposes of the present invention, alpha amylase activity can be determined using an alpha amylase assay described in the examples section below.

Auxiliary Activity 9: The term "Auxiliary Activity 9" or "AA9" means a polypeptide classified as a lytic polysaccharide monooxygenase (Quinlan et al., 2011, *Proc. Natl. Acad. Sci. USA* 208: 15079-15084; Phillips et al., 2011, *ACS Chem. Biol.* 6: 1399-1406; Lin et al., 2012, *Structure* 20: 1051-1061). AA9 polypeptides were formerly classified into the glycoside hydrolase Family 61 (GH61) according to Henrissat, 1991, *Biochem. J.* 280: 309-316, and Henrissat and Bairoch, 1996, *Biochem. J.* 316: 695-696.

AA9 polypeptides enhance the hydrolysis of a cellulosic-containing material by an enzyme having cellulolytic activity. Cellulolytic enhancing activity can be determined by measuring the increase in reducing sugars or the increase of the total of cellobiose and glucose from the hydrolysis of a cellulosic-containing material by cellulolytic enzyme under the following conditions: 1-50 mg of total protein/g of cellulose in pretreated corn stover (PCS), wherein total protein is comprised of 50-99.5% w/w cellulolytic enzyme protein and 0.5-50% w/w protein of an AA9 polypeptide for 1-7 days at a suitable temperature, such as 40 C-80° C., e.g., 50° C., 55° C., 60° C., 65° C., or 70° C., and a suitable pH, such as 4-9, e.g., 4.5, 5.0, 5.5, 6.0, 6.5, 7.0, 7.5, 8.0, or 8.5, compared to a control hydrolysis with equal total protein loading without cellulolytic enhancing activity (1-50 mg of cellulolytic protein/g of cellulose in PCS).

AA9 polypeptide enhancing activity can be determined using a mixture of CELLUCLAST® 1.5 L (Novozymes A/S, Bagsværd, Denmark) and beta-glucosidase as the source of the cellulolytic activity, wherein the beta-glucosidase is present at a weight of at least 2-5% protein of the cellulase protein loading. In one embodiment, the beta-glucosidase is an *Aspergillus oryzae* beta-glucosidase (e.g., recombinantly produced in *Aspergillus oryzae* according to WO02/095014). In another embodiment, the beta-glucosidase is an *Aspergillus fumigatus* beta-glucosidase (e.g., recombinantly produced in *Aspergillus oryzae* as described in WO02/095014).

AA9 polypeptide enhancing activity can also be determined by incubating an AA9 polypeptide with 0.5% phosphoric acid swollen cellulose (PASC), 100 mM sodium acetate pH 5, 1 mM $MnSO_4$, 0.1% gallic acid, 0.025 mg/ml of *Aspergillus fumigatus* beta-glucosidase, and 0.01% TRITON® X-100 (4-(1,1,3,3-tetramethylbutyl)phenyl-polyethylene glycol) for 24-96 hours at 40° C. followed by determination of the glucose released from the PASC.

AA9 polypeptide enhancing activity can also be determined according to WO2013/028928 for high temperature compositions.

AA9 polypeptides enhance the hydrolysis of a cellulosic-containing material catalyzed by enzyme having cellulolytic activity by reducing the amount of cellulolytic enzyme required to reach the same degree of hydrolysis preferably at least 1.01-fold, e.g., at least 1.05-fold, at least 1.10-fold, at least 1.25-fold, at least 1.5-fold, at least 2-fold, at least 3-fold, at least 4-fold, at least 5-fold, at least 10-fold, or at least 20-fold.

Beta-glucosidase: The term "beta-glucosidase" means a beta-D-glucoside glucohydrolase (E.C. 3.2.1.21) that catalyzes the hydrolysis of terminal non-reducing beta-D-glucose residues with the release of beta-D-glucose. Beta-glucosidase activity can be determined using p-nitrophenyl-beta-D-glucopyranoside as substrate according to the procedure of Venturi et al., 2002, *J. Basic Microbiol.* 42: 55-66. One unit of beta-glucosidase is defined as 1.0 μmole of p-nitrophenolate anion produced per minute at 25° C., pH 4.8 from 1 mM p-nitrophenyl-beta-D-glucopyranoside as substrate in 50 mM sodium citrate containing 0.01% TWEEN® 20.

Beta-xylosidase: The term "beta-xylosidase" means a beta-D-xyloside xylohydrolase (E.C. 3.2.1.37) that catalyzes the exo-hydrolysis of short beta (1→4)-xylooligosaccharides to remove successive D-xylose residues from non-reducing termini. Beta-xylosidase activity can be determined using 1 mM p-nitrophenyl-beta-D-xyloside as substrate in 100 mM sodium citrate containing 0.01% TWEEN® 20 at pH 5, 40° C. One unit of beta-xylosidase is defined as 1.0 μmole of p-nitrophenolate anion produced per minute at 40° C., pH 5 from 1 mM p-nitrophenyl-beta-D-xyloside in 100 mM sodium citrate containing 0.01% TWEEN® 20.

Catalase: The term "catalase" means a hydrogen-peroxide:hydrogen-peroxide oxidoreductase (EC 1.11.1.6) that catalyzes the conversion of $2H_2O_2$ to $O_2+2\ H_2O$. For purposes of the present invention, catalase activity is determined according to U.S. Pat. No. 5,646,025. One unit of catalase activity equals the amount of enzyme that catalyzes the oxidation of 1 μmole of hydrogen peroxide under the assay conditions.

Catalytic domain: The term "catalytic domain" means the region of an enzyme containing the catalytic machinery of the enzyme.

Cellobiohydrolase: The term "cellobiohydrolase" means a 1,4-beta-D-glucan cellobiohydrolase (E.C. 3.2.1.91 and E.C. 3.2.1.176) that catalyzes the hydrolysis of 1,4-beta-D-glucosidic linkages in cellulose, cellooligosaccharides, or any beta-1,4-linked glucose containing polymer, releasing cellobiose from the reducing end (cellobiohydrolase 1) or non-reducing end (cellobiohydrolase 11) of the chain (Teeri, 1997, *Trends in Biotechnology* 15: 160-167; Teen et al., 1998, *Biochem. Soc. Trans.* 26: 173-178). Cellobiohydrolase activity can be determined according to the procedures described by Lever et al., 1972, *Anal. Biochem.* 47: 273-279; van Tilbeurgh et al., 1982, *FEBS Letters* 149: 152-156; van Tilbeurgh and Claeyssens, 1985, *FEBS Letters* 187: 283-288; and Tomme et al., 1988, *Eur. J. Biochem.* 170: 575-581.

Cellulolytic enzyme or cellulase: The term "cellulolytic enzyme" or "cellulase" means one or more (e.g., several) enzymes that hydrolyze a cellulosic-containing material. Such enzymes include endoglucanase(s), cellobiohydrolase(s), beta-glucosidase(s), or combinations thereof. The two basic approaches for measuring cellulolytic enzyme activity include: (1) measuring the total cellulolytic enzyme activity, and (2) measuring the individual cellulolytic enzyme activities (endoglucanases, cellobiohydrolases, and beta-glucosidases) as reviewed in Zhang et al., 2006, *Biotechnology Advances* 24: 452-481. Total cellulolytic enzyme activity can be measured using insoluble substrates, including Whatman No 1 filter paper, microcrystalline cellulose, bacterial cellulose, algal cellulose, cotton, pretreated lignocellulose, etc. The most common total cellulolytic activity assay is the filter paper assay using Whatman No 1 filter paper as the substrate. The assay was established by the *International Union of Pure and Applied Chemistry* (IUPAC) (Ghose, 1987, *Pure Appl. Chem.* 59: 257-68).

Cellulolytic enzyme activity can be determined by measuring the increase in production/release of sugars during hydrolysis of a cellulosic-containing material by cellulolytic enzyme(s) under the following conditions: 1-50 mg of cellulolytic enzyme protein/g of cellulose in pretreated corn stover (PCS) (or other pretreated cellulosic-containing material) for 3-7 days at a suitable temperature such as 40° C.-80° C., e.g., 50° C., 55° C., 60° C., 65° C., or 70° C., and a suitable pH such as 4-9, e.g., 5.0, 5.5, 6.0, 6.5, or 7.0, compared to a control hydrolysis without addition of cellulolytic enzyme protein. Typical conditions are 1 ml reactions, washed or unwashed PCS, 5% insoluble solids (dry weight), 50 mM sodium acetate pH 5, 1 mM $MnSO_4$, 50° C., 55° C., or 60° C., 72 hours, sugar analysis by AMINEX® HPX-87H column chromatography (Bio-Rad Laboratories, Inc., Hercules, CA, USA).

Coding sequence: The term "coding sequence" or "coding region" means a polynucleotide sequence, which specifies the amino acid sequence of a polypeptide. The boundaries of the coding sequence are generally determined by an open reading frame, which usually begins with the ATG start codon or alternative start codons such as GTG and TTG and ends with a stop codon such as TAA, TAG, and TGA. The coding sequence may be a sequence of genomic DNA, cDNA, a synthetic polynucleotide, and/or a recombinant polynucleotide.

Control sequence: The term "control sequence" means a nucleic acid sequence necessary for polypeptide expression. Control sequences may be native or foreign to the polynucleotide encoding the polypeptide, and native or foreign to each other. Such control sequences include, but are not limited to, a leader sequence, polyadenylation sequence, propeptide sequence, promoter sequence, signal peptide sequence, and transcription terminator sequence. The control sequences may be provided with linkers for the purpose of introducing specific restriction sites facilitating ligation of the control sequences with the coding region of the polynucleotide encoding a polypeptide.

Disruption: The term "disruption" means that a coding region and/or control sequence of a referenced gene is partially or entirely modified (such as by deletion, insertion, and/or substitution of one or more nucleotides) resulting in the absence (inactivation) or decrease in expression, and/or the absence or decrease of enzyme activity of the encoded polypeptide. The effects of disruption can be measured using techniques known in the art such as detecting the absence or decrease of enzyme activity using from cell-free extract measurements referenced herein; or by the absence or decrease of corresponding mRNA (e.g., at least 25% decrease, at least 50% decrease, at least 60% decrease, at least 70% decrease, at least 80% decrease, or at least 90% decrease); the absence or decrease in the amount of corresponding polypeptide having enzyme activity (e.g., at least 25% decrease, at least 50% decrease, at least 60% decrease, at least 70% decrease, at least 80% decrease, or at least 90% decrease); or the absence or decrease of the specific activity of the corresponding polypeptide having enzyme activity (e.g., at least 25% decrease, at least 50% decrease, at least 60% decrease, at least 70% decrease, at least 80% decrease, or at least 90% decrease). Disruptions of a particular gene of interest can be generated by methods known in the art, e.g., by directed homologous recombination (see *Methods in Yeast Genetics* (1997 edition), Adams, Gottschling, Kaiser, and Stems, Cold Spring Harbor Press (1998)).

Endogenous gene: The term "endogenous gene" means a gene that is native to the referenced host cell. "Endogenous gene expression" means expression of an endogenous gene.

Endoglucanase: The term "endoglucanase" means a 4-(1, 3;1,4)-beta-D-glucan 4-glucanohydrolase (E.C. 3.2.1.4) that catalyzes endohydrolysis of 1,4-beta-D-glycosidic linkages in cellulose, cellulose derivatives (such as carboxymethyl cellulose and hydroxyethyl cellulose), lichenin, beta-1,4 bonds in mixed beta-1,3-1,4 glucans such as cereal beta-D-glucans or xyloglucans, and other plant material containing cellulosic components.

Endoglucanase activity can be determined by measuring reduction in substrate viscosity or increase in reducing ends determined by a reducing sugar assay (Zhang et al., 2006, *Biotechnology Advances* 24: 452-481). Endoglucanase activity can also be determined using carboxymethyl cellulose (CMC) as substrate according to the procedure of Ghose, 1987, *Pure and Appl. Chem.* 59: 257-268, at pH 5, 40° C.

Expression: The term "expression" includes any step involved in the production of the polypeptide including, but not limited to, transcription, post-transcriptional modification, translation, post-translational modification, and secretion. Expression can be measured—for example, to detect increased expression—by techniques known in the art, such as measuring levels of mRNA and/or translated polypeptide.

Expression vector: The term "expression vector" means a linear or circular DNA molecule that comprises a polynucleotide encoding a polypeptide and is operably linked to control sequences that provide for its expression.

Fermentable medium: The term "fermentable medium" or "fermentation medium" refers to a medium comprising one or more (e.g., two, several) sugars, such as glucose, fructose, sucrose, cellobiose, xylose, xylulose, arabinose, mannose, galactose, and/or soluble oligosaccharides, wherein the medium is capable, in part, of being converted (fermented) by a host cell into a desired product, such as ethanol. In some instances, the fermentation medium is derived from a natural source, such as sugar cane, starch, or cellulose, and may be the result of pretreating the source by enzymatic hydrolysis (saccharification). The term fermentation medium is understood herein to refer to a medium before the fermenting organism is added, such as, a medium resulting from a saccharification process, as well as a medium used in a simultaneous saccharification and fermentation process (SSF).

Glucoamylase: The term "glucoamylase" (1,4-alpha-D-glucan glucohydrolase, EC 3.2.1.3) is defined as an enzyme that catalyzes the release of D-glucose from the non-reducing ends of starch or related oligo- and polysaccharide molecules. For purposes of the present invention, glucoamylase activity may be determined according to the procedure described in the Examples herein.

Hemicellulolytic enzyme or hemicellulase: The term "hemicellulolytic enzyme" or "hemicellulase" means one or more (e.g., several) enzymes that hydrolyze a hemicellulosic material. See, for example, Shallom and Shoham, 2003, *Current Opinion In Microbiology* 6(3): 219-228). Hemicellulases are key components in the degradation of plant biomass. Examples of hemicellulases include, but are not limited to, an acetylmannan esterase, an acetylxylan esterase, an arabinanase, an arabinofuranosidase, a coumaric acid esterase, a feruloyl esterase, a galactosidase, a glucuronidase, a glucuronoyl esterase, a mannanase, a mannosidase, a xylanase, and a xylosidase. The substrates for these enzymes, hemicelluloses, are a heterogeneous group of branched and linear polysaccharides that are bound via hydrogen bonds to the cellulose microfibrils in the plant cell wall, crosslinking them into a robust network. Hemicelluloses are also covalently attached to lignin, forming together with cellulose a highly complex structure. The variable structure and organization of hemicelluloses require the concerted action of many enzymes for its complete degradation. The catalytic modules of hemicellulases are either glycoside hydrolases (GHs) that hydrolyze glycosidic bonds, or carbohydrate esterases (CEs), which hydrolyze ester linkages of acetate or ferulic acid side groups. These catalytic modules, based on homology of their primary sequence, can be assigned into GH and CE families. Some families, with an overall similar fold, can be further grouped into clans, marked alphabetically (e.g., GH-A). A most informative and updated classification of these and other carbohydrate active enzymes is available in the Carbohydrate-Active Enzymes (CAZy) database. Hemicellulolytic enzyme activities can be measured according to Ghose and Bisaria, 1987, *Pure & Appl. Chem.* 59: 1739-1752, at a suitable temperature such as 40° C.-80° C., e.g., 50° C., 55° C., 60° C., 65° C., or 70° C., and a suitable pH such as 4-9, e.g., 5.0, 5.5, 6.0, 6.5, or 7.0.

Heterologous polynucleotide: The term "heterologous polynucleotide" is defined herein as a polynucleotide that is not native to the host cell; a native polynucleotide in which structural modifications have been made to the coding region; a native polynucleotide whose expression is quantitatively altered as a result of a manipulation of the DNA by recombinant DNA techniques, e.g., a different (foreign) promoter; or a native polynucleotide in a host cell having one or more extra copies of the polynucleotide to quantitatively alter expression. A "heterologous gene" is a gene comprising a heterologous polynucleotide.

High stringency conditions: The term "high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 0.2×SSC, 0.2% SDS at 65° C.

Host cell: The term "host cell" means any cell type that is susceptible to transformation, transfection, transduction, and the like with a nucleic acid construct or expression vector comprising a polynucleotide described herein (e.g., a polynucleotide encoding an alpha-amylase and/or trehalase). The term "host cell" encompasses any progeny of a parent cell that is not identical to the parent cell due to mutations that occur during replication. The term "recombinant cell" is defined herein as a non-naturally occurring host cell comprising one or more (e.g., two, several) heterologous polynucleotides.

Low stringency conditions: The term "low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 0.2×SSC, 0.2% SDS at 50° C.

Mature polypeptide: The term "mature polypeptide" is defined herein as a polypeptide having biological activity that is in its final form following translation and any post-translational modifications, such as N-terminal processing, C-terminal truncation, glycosylation, phosphorylation, etc. The mature polypeptide sequence lacks a signal sequence, which may be determined using techniques known in the art (See, e.g., Zhang and Henzel, 2004, *Protein Science* 13: 2819-2824).

Medium stringency conditions: The term "medium stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 0.2×SSC, 0.2% SDS at 55° C.

Medium-high stringency conditions: The term "medium-high stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 0.2×SSC, 0.2% SDS at 60° C.

Nucleic acid construct: The term "nucleic acid construct" means a polynucleotide comprises one or more (e.g., two, several) control sequences. The polynucleotide may be single-stranded or double-stranded, and may be isolated from a naturally occurring gene, modified to contain segments of nucleic acids in a manner that would not otherwise exist in nature, or synthetic.

Operably linked: The term "operably linked" means a configuration in which a control sequence is placed at an appropriate position relative to the coding sequence of a polynucleotide such that the control sequence directs expression of the coding sequence.

Pretreated corn stover: The term "Pretreated Corn Stover" or "PCS" means a cellulosic-containing material derived from corn stover by treatment with heat and dilute sulfuric acid, alkaline pretreatment, neutral pretreatment, or any pretreatment known in the art.

Protease: The term "protease" is defined herein as an enzyme that hydrolyses peptide bonds. It includes any enzyme belonging to the EC 3.4 enzyme group (including each of the thirteen subclasses thereof). The EC number refers to Enzyme Nomenclature 1992 from NC-IUBMB, Academic Press, San Diego, California, including supplements 1-5 published in Eur. *J. Biochem.* 223: 1-5 (1994); *Eur. J. Biochem.* 232: 1-6 (1995); *Eur. J. Biochem.* 237: 1-5 (1996); *Eur. J. Biochem.* 250: 1-6 (1997); and *Eur. J. Biochem.* 264: 610-650 (1999); respectively. The term "subtilases" refer to a sub-group of serine protease according to Siezen et al., 1991, *Protein Engng.* 4: 719-737 and Siezen et al., 1997, *Protein Science* 6: 501-523. Serine proteases or serine peptidases is a subgroup of proteases characterised by having a serine in the active site, which forms a covalent adduct with the substrate. Further the subtilases (and the serine proteases) are characterised by having two active site amino acid residues apart from the serine, namely a histidine and an aspartic acid residue. The subtilases may be divided into 6 sub-divisions, i.e. the Subtilisin family, the Thermitase family, the Proteinase K family, the Lantibiotic peptidase family, the Kexin family and the Pyrolysin family. The term "protease activity" means a proteolytic activity (EC 3.4). Protease activity may be determined using methods described in the art (e.g., US 2015/0125925) or using commercially available assay kits (e.g., Sigma-Aldrich).

Pullulanase: The term "pullulanase" means a starch debranching enzyme having pullulan 6-glucano-hydrolase activity (EC 3.2.1.41) that catalyzes the hydrolysis the α-1,6-glycosidic bonds in pullulan, releasing maltotriose with reducing carbohydrate ends. For purposes of the present invention, pullulanase activity can be determined according to a PHADEBAS assay or the sweet potato starch assay described in WO2016/087237.

Sequence Identity: The relatedness between two amino acid sequences or between two nucleotide sequences is described by the parameter "sequence identity".

For purposes described herein, the degree of sequence identity between two amino acid sequences is determined using the Needleman-Wunsch algorithm (Needleman and Wunsch, *J. Mol. Biol.* 1970, 48, 443-453) as implemented in the Needle program of the EMBOSS package (EMBOSS: The European Molecular Biology Open Software Suite, Rice et al., *Trends Genet* 2000, 16, 276-277), preferably version 3.0.0 or later. The optional parameters used are gap open penalty of 10, gap extension penalty of 0.5, and the EBLOSUM62 (EMBOSS version of BLOSUM62) substitution matrix. The output of Needle labeled "longest identity" (obtained using the—nobrief option) is used as the percent identity and is calculated as follows:

(Identical Residues×100)/(Length of the Referenced Sequence−Total Number of Gaps in Alignment)

For purposes described herein, the degree of sequence identity between two deoxyribonucleotide sequences is determined using the Needleman-Wunsch algorithm (Needleman and Wunsch, 1970, supra) as implemented in the Needle program of the EMBOSS package (EMBOSS: The European Molecular Biology Open Software Suite, Rice et al., 2000, supra), preferably version 3.0.0 or later. The optional parameters used are gap open penalty of 10, gap extension penalty of 0.5, and the EDNAFULL (EMBOSS version of NCBI NUC4.4) substitution matrix. The output of Needle labeled "longest identity" (obtained using the—nobrief option) is used as the percent identity and is calculated as follows:

(Identical Deoxyribonucleotides×100)/(Length of Referenced Sequence−Total Number of Gaps in Alignment)

Signal peptide: The term "signal peptide" is defined herein as a peptide linked (fused) in frame to the amino terminus of a polypeptide having biological activity and directs the polypeptide into the cell's secretory pathway. Signal sequences may be determined using techniques known in the art (See, e.g., Zhang and Henzel, 2004, *Protein Science* 13: 2819-2824). The polypeptides described herein may comprise any suitable signal peptide known in the art, or any signal peptide described herein (e.g., the *S. cerevisiae* MFα1 signal peptide of SEQ ID NO: 7, the *S. cerevisiae* EXG1 signal peptide of SEQ ID NO: 227, or the *S. cerevisiae* AG2 signal peptide of SEQ ID NO: 234, or a signal peptide having at least 80%, 85%, 90%, 95%, 96%, 97%, 98% or 99% sequence identity thereof).

Trehalase: The term "trehalase" means an enzyme which degrades trehalose into its unit monosaccharides (i.e., glucose). Trehalases are classified in EC 3.2.1.28 (alpha,alpha-trehalase) and EC. 3.2.1.93 (alpha,alpha-phosphotrehalase). The EC classes are based on recommendations of the Nomenclature Committee of the International Union of Biochemistry and Molecular Biology (IUBMB). Description of EC classes can be found on the internet, e.g., on "http://www.expasy.org/enzyme/". Trehalases are enzymes that catalyze the following reactions:

EC 3.2.1.28: Alpha,alpha-trehalose+$H_2O$ ⇌ 2 D-glucose;

EC 3.2.1. 93: Alpha,alpha-trehalose 6-phosphate+ $H_2O$ ⇌ D-glucose+D-glucose 6-phosphate.

For purposes of the present invention, trehalase activity may be determined according to the trehalase activity assay described herein in the experimental section.

Very high stringency conditions: The term "very high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 0.2×SSC, 0.2% SDS at 70° C.

Very low stringency conditions: The term "very low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 0.2×SSC, 0.2% SDS at 45° C.

Xylanase: The term "xylanase" means a 1,4-beta-D-xylan-xylohydrolase (E.C. 3.2.1.8) that catalyzes the endohydrolysis of 1,4-beta-D-xylosidic linkages in xylans. Xylanase activity can be determined with 0.2% AZCL-arabinoxylan as substrate in 0.01% TRITON® X-100 and 200 mM sodium phosphate pH 6 at 37° C. One unit of xylanase activity is defined as 1.0 μmole of azurine produced per minute at 37° C., pH 6 from 0.2% AZCL-arabinoxylan as substrate in 200 mM sodium phosphate pH 6.

Xylose Isomerase: The term "Xylose Isomerase" or "XI" means an enzyme which can catalyze D-xylose into D-xylulose in vivo, and convert D-glucose into D-fructose in vitro. Xylose isomerase is also known as "glucose isomerase" and is classified as E.C. 5.3.1.5. As the structure of the enzyme is very stable, the xylose isomerase is a good model for studying the relationships between protein structure and functions (Karimaki et al., *Protein Eng Des Sel,* 12004, 17 (12):861-869). Xylose Isomerase activity may be determined using techniques known in the art (e.g., a coupled enzyme assay using D-sorbitol dehygrogenase, as described by Verhoeven et. al., 2017, *Sci Rep* 7, 46155).

Reference to "about" a value or parameter herein includes embodiments that are directed to that value or parameter per se. For example, description referring to "about X" includes the embodiment "X". When used in combination with measured values, "about" includes a range that encompasses at least the uncertainty associated with the method of measuring the particular value, and can include a range of plus or minus two standard deviations around the stated value.

Likewise, reference to a gene or polypeptide that is "derived from" another gene or polypeptide X, includes the gene or polypeptide X.

As used herein and in the appended claims, the singular forms "a," "or," and "the" include plural referents unless the context clearly dictates otherwise.

It is understood that the embodiments described herein include "consisting" and/or "consisting essentially of" embodiments. As used herein, except where the context requires otherwise due to express language or necessary implication, the word "comprise" or variations such as "comprises" or "comprising" is used in an inclusive sense, i.e. to specify the presence of the stated features but not to preclude the presence or addition of further features in various embodiments.

DETAILED DESCRIPTION

Described herein, inter alia, are methods for producing a fermentation product, such as ethanol, from starch or cellulosic containing material.

During industrial scale fermentation, yeast encounter various physiological challenges including variable concentrations of sugars, high concentrations of yeast metabolites such as ethanol, glycerol, organic acids, osmotic stress, as well as potential competition from contaminating microbes such as wild yeasts and bacteria. As a consequence, many yeasts are not suitable for use in industrial fermentation. The most widely used commercially available industrial strain of *Saccharomyces* (i.e. for industrial scale fermentation) is the *Saccharomyces cerevisiae* strain used, for example, in the product ETHANOL RED®. This strain is well suited to industrial ethanol production; however, it remains unclear how modifications to the yeast will impact performance. In particular, the functional expression of heterologous enzymes by an industrially-relevant *Saccharomyces cerevisiae* yeast is uncertain (See, for example U.S. Pat. No. 9,206,444 where the applicant was unable to functionally express numerous enzymes/enzyme classes).

The Applicant has surprisingly found that yeast expressing certain alpha-amylases and/or trehalases provide beneficial properties that may be useful for ethanol fermentation.

In one aspect is a method of producing a fermentation product from a starch-containing or cellulosic-containing material comprising:
 (a) saccharifying the starch-containing or cellulosic-containing material; and
 (b) fermenting the saccharified material of step (a) with a fermenting organism;
 wherein the fermenting organism comprises a heterologous polynucleotide encoding an alpha-amylase or a heterologous polynucleotide encoding a trehalase.

Steps of saccharifying and fermenting are carried out either sequentially or simultaneously (SSF). In one embodiment, steps of saccharifying and fermenting are carried out simultaneously (SSF). In another embodiment, steps of saccharifying and fermenting are carried out sequentially.

Fermenting Organism

The fermenting organism described herein may be derived from any host cell known to the skilled artisan capable of producing a fermentation product, such as ethanol. As used herein, a "derivative" of strain is derived from a referenced strain, such as through mutagenesis, recombinant DNA technology, mating, cell fusion, or cytoduction between yeast strains. Those skilled in the art will understand that the genetic alterations, including metabolic modifications exemplified herein, may be described with reference to a suitable host organism and their corresponding metabolic reactions or a suitable source organism for desired genetic material such as genes for a desired metabolic pathway. However, given the complete genome sequencing of a wide variety of organisms and the high level of skill in the area of genomics, those skilled in the art can apply the teachings and guidance provided herein to other organisms. For example, the metabolic alterations exemplified herein can readily be applied to other species by incorporating the same or analogous encoding nucleic acid from species other than the referenced species.

The host cells for preparing the recombinant cells described herein can be from any suitable host, such as a yeast strain, including, but not limited to, a *Saccharomyces, Rhodotorula, Schizosaccharomyces, Kluyveromyces, Pichia, Hansenula, Rhodosporidium, Candida, Yarrowia, Lipomyces, Cryptococcus,* or *Dekkera* sp. cell. In particular, *Saccharomyces* host cells are contemplated, such as *Saccharomyces cerevisiae, bayanus* or *carlsbergensis* cells. Preferably, the yeast cell is a *Saccharomyces cerevisiae* cell. Suitable cells can, for example, be derived from commercially available strains and polyploid or aneuploid industrial strains, including but not limited to those from Superstart™, THERMOSACC®, C5 FUEL™, XyloFerm®, etc. (Lallemand); RED STAR and ETHANOL RED® (Fermentis/Lesaffre); FALI (AB Mauri); Baker's Best Yeast, Baker's Compressed Yeast, etc. (Fleishmann's Yeast); BIOFERM AFT, XP, CF, and XR (North American Bioproducts Corp.); Turbo Yeast (Gert Strand AB); and FERMIOL® (DSM Specialties). Other useful yeast strains are available from biological depositories such as the American Type Culture Collection (ATCC) or the Deutsche Sammlung von Mikroorganismen und Zellkulturen GmbH (DSMZ), such as, e.g., BY4741 (e.g., ATCC 201388); Y108-1 (ATCC PTA.10567) and NRRL YB-1952 (ARS Culture Collection). Still other *S. cerevisiae* strains suitable as host cells DBY746, [Alpha][Eta]22, S150-2B, GPY55-15Ba, CEN.PK, USM21, TMB3500, TMB3400, VTT-A-63015, VTT-A-85068, VTT-c-79093 and their derivatives as well as *Saccharomyces* sp. 1400, 424A (LNH-ST), 259A (LNH-ST) and derivatives thereof. In one embodiment, the recombinant cell is a derivative of a strain *Saccharomyces cerevisiae* CIBTS1260 (deposited under Accession No. NRRL Y-50973 at the *Agricultural Research* Service Culture Collection (NRRL), Illinois 61604 U.S.A.).

The fermenting organism may be *Saccharomyces* strain, e.g., *Saccharomyces cerevisiae* strain produced using the method described and concerned in U.S. Pat. No. 8,257,959-BB.

The strain may also be a derivative of *Saccharomyces cerevisiae* strain NMI V14/004037 (See, WO2015/143324 and WO2015/143317 each incorporated herein by reference), strain nos. V15/004035, V15/004036, and V15/004037 (See, WO2016/153924 incorporated herein by reference), strain nos. V15/001459, V15/001460, V15/001461 (See, WO2016/138437 incorporated herein by reference), strain no. NRRL Y67342 (See, WO2017/063159 incorporated herein by reference), or any strain described in WO2017/087330 (incorporated herein by reference).

The fermenting organisms according to the invention have been generated in order to improve fermentation yield and to improve process economy by cutting enzyme costs since part or all of the necessary enzymes needed to improve method performance are be produced by the fermenting organism.

The fermenting organisms described herein may utilize expression vectors comprising the coding sequence of one or more (e.g., two, several) heterologous genes linked to one or more control sequences that direct expression in a suitable cell under conditions compatible with the control sequence(s). Such expression vectors may be used in any of the cells and methods described herein. The polynucleotides described herein may be manipulated in a variety of ways to provide for expression of a desired polypeptide. Manipulation of the polynucleotide prior to its insertion into a vector may be desirable or necessary depending on the expression vector. The techniques for modifying polynucleotides utilizing recombinant DNA methods are well known in the art.

A construct or vector (or multiple constructs or vectors) comprising the one or more (e.g., two, several) heterologous genes may be introduced into a cell so that the construct or vector is maintained as a chromosomal integrant or as a self-replicating extra-chromosomal vector as described earlier.

The various nucleotide and control sequences may be joined together to produce a recombinant expression vector that may include one or more (e.g., two, several) convenient restriction sites to allow for insertion or substitution of the polynucleotide at such sites. Alternatively, the polynucleotide(s) may be expressed by inserting the polynucleotide(s) or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector may be a linear or closed circular plasmid.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the cell, or a transposon, may be used.

The expression vector may contain any suitable promoter sequence that is recognized by a cell for expression of a gene described herein. The promoter sequence contains transcriptional control sequences that mediate the expression of the polypeptide. The promoter may be any polynucleotide that shows transcriptional activity in the cell of choice including mutant, truncated, and hybrid promoters, and may be obtained from genes encoding extracellular or intracellular polypeptides either homologous or heterologous to the cell.

Each heterologous polynucleotide described herein may be operably linked to a promoter that is foreign to the polynucleotide. For example, in one embodiment, the heterologous polynucleotide encoding the hexose transporter is operably linked to a promoter foreign to the polynucleotide. The promoters may be identical to or share a high degree of sequence identity (e.g., at least about 80%, at least about 85%, at least about 90%, at least about 95%, at least about 96%, at least about 97%, at least about 98%, or at least about 99%) with a selected native promoter.

Examples of suitable promoters for directing the transcription of the nucleic acid constructs in a yeast cells, include, but are not limited to, the promoters obtained from the genes for enolase, (e.g., *S. cerevisiae* enolase or *I. orientalis* enolase (ENO1)), galactokinase (e.g., *S. cerevisiae* galactokinase or *I. orientalis* galactokinase (GAL1)), alcohol dehydrogenase/glyceraldehyde-3-phosphate dehydrogenase (e.g., *S. cerevisiae* alcohol dehydrogenase/glyceraldehyde-3-phosphate dehydrogenase or *I. orientalis* alcohol dehydrogenase/glyceraldehyde-3-phosphate dehydrogenase (ADH1, ADH2/GAP)), triose phosphate isomerase (e.g., *S. cerevisiae* triose phosphate isomerase or *I. orientalis* triose phosphate isomerase (TPI)), metallothionein (e.g., *S. cerevisiae* metallothionein or *I. orientalis* metallothionein (CUP1)), 3-phosphoglycerate kinase (e.g., *S. cerevisiae* 3-phosphoglycerate kinase or *I. orientalis* 3-phosphoglycerate kinase (PGK)), PDC1, xylose reductase (XR), xylitol dehydrogenase (XDH), L-(+)-lactate-cytochrome c oxidoreductase (CYB2), translation elongation factor-1 (TEF1), translation elongation factor-2 (TEF2), glyceraldehyde-3-phosphate dehydrogenase (GAPDH), and orotidine 5'-phosphate decarboxylase (URA3) genes. Other suitable promoters may be obtained from *S. cerevisiae* TDH3, HXT7, PGK1, RPL18B and CCW12 genes. Additional useful promoters for yeast host cells are described by Romanos et al., 1992, *Yeast* 8: 423-488.

The control sequence may also be a suitable transcription terminator sequence, which is recognized by a host cell to terminate transcription. The terminator sequence is operably linked to the 3'-terminus of the polynucleotide encoding the polypeptide. Any terminator that is functional in the yeast cell of choice may be used. The terminator may be identical to or share a high degree of sequence identity (e.g., at least about 80%, at least about 85%, at least about 90%, at least about 95%, at least about 96%, at least about 97%, at least about 98%, or at least about 99%) with the selected native terminator.

Suitable terminators for yeast host cells may be obtained from the genes for enolase (e.g., *S. cerevisiae* or *I. orientalis* enolase cytochrome C (e.g., *S. cerevisiae* or *I. orientalis* cytochrome (CYC1)), glyceraldehyde-3-phosphate dehydrogenase (e.g., *S. cerevisiae* or *I. orientalis* glyceraldehyde-3-phosphate dehydrogenase (gpd)), PDC1, XR, XDH, transaldolase (TAL), transketolase (TKL), ribose 5-phosphate ketol-isomerase (RKI), CYB2, and the galactose family of genes (especially the GAL10 terminator). Other suitable terminators may be obtained from *S. cerevisiae* ENO2 or TEF1 genes. Additional useful terminators for yeast host cells are described by Romanos et al., 1992, supra.

The control sequence may also be an mRNA stabilizer region downstream of a promoter and upstream of the coding sequence of a gene which increases expression of the gene.

Examples of suitable mRNA stabilizer regions are obtained from a *Bacillus thuringiensis* cry//IA gene (WO94/25612) and a *Bacillus subtilis* SP82 gene (Hue et al., 1995, *Journal of Bacteriology* 177: 3465-3471).

The control sequence may also be a suitable leader sequence, when transcribed is a nontranslated region of an mRNA that is important for translation by the host cell. The leader sequence is operably linked to the 5'-terminus of the polynucleotide encoding the polypeptide. Any leader sequence that is functional in the yeast cell of choice may be used.

Suitable leaders for yeast host cells are obtained from the genes for enolase (e.g., *S. cerevisiae* or *I. orientalis* enolase (ENO-1)), 3-phosphoglycerate kinase (e.g., *S. cerevisiae* or *I. orientalis* 3-phosphoglycerate kinase), alpha-factor (e.g., *S. cerevisiae* or *I. orientalis* alpha-factor), and alcohol dehydrogenase/glyceraldehyde-3-phosphate dehydrogenase (e.g., *S. cerevisiae* or *I. orientalis* alcohol dehydrogenase/glyceraldehyde-3-phosphate dehydrogenase (ADH2/GAP)).

The control sequence may also be a polyadenylation sequence; a sequence operably linked to the 3'-terminus of the polynucleotide and, when transcribed, is recognized by the host cell as a signal to add polyadenosine residues to transcribed mRNA. Any polyadenylation sequence that is functional in the host cell of choice may be used. Useful polyadenylation sequences for yeast cells are described by Guo and Sherman, 1995, *Mol. Cellular Biol.* 15: 5983-5990.

It may also be desirable to add regulatory sequences that allow the regulation of the expression of the polypeptide relative to the growth of the host cell. Examples of regulatory systems are those that cause the expression of the gene to be turned on or off in response to a chemical or physical stimulus, including the presence of a regulatory compound. Regulatory systems in prokaryotic systems include the lac, tac, and trp operator systems. In yeast, the ADH2 system or GAL1 system may be used.

The vectors may contain one or more (e.g., two, several) selectable markers that permit easy selection of transformed, transfected, transduced, or the like cells. A selectable marker is a gene the product of which provides for biocide or viral resistance, resistance to heavy metals, prototrophy to auxotrophs, and the like. Suitable markers for yeast host cells include, but are not limited to, ADE2, HIS3, LEU2, LYS2, MET3, TRP1, and URA3.

The vectors may contain one or more (e.g., two, several) elements that permit integration of the vector into the host cell's genome or autonomous replication of the vector in the cell independent of the genome.

For integration into the host cell genome, the vector may rely on the polynucleotide's sequence encoding the polypeptide or any other element of the vector for integration into the genome by homologous or non-homologous recombination. Alternatively, the vector may contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination. Potential integration loci include those described in the art (e.g., See US2012/0135481).

For autonomous replication, the vector may further comprise an origin of replication enabling the vector to replicate autonomously in the yeast cell. The origin of replication may be any plasmid replicator mediating autonomous replication that functions in a cell. The term "origin of replication" or "plasmid replicator" means a polynucleotide that enables a plasmid or vector to replicate in vivo. Examples of origins of replication for use in a yeast host cell are the 2 micron origin of replication, ARS1, ARS4, the combination of ARS1 and CEN3, and the combination of ARS4 and CEN6.

More than one copy of a polynucleotide described herein may be inserted into a host cell to increase production of a polypeptide. An increase in the copy number of the polynucleotide can be obtained by integrating at least one additional copy of the sequence into the yeast cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors described herein are well known to one skilled in the art (see, e.g., Sambrook et al., 1989, *Molecular Cloning, A Laboratory Manual*, 2d edition, Cold Spring Harbor, New York).

Additional procedures and techniques known in the art for the preparation of recombinant cells for ethanol fermentation, are described in, e.g., WO2016/045569, the content of which is hereby incorporated by reference.

The fermenting organism may be in the form of a composition comprising a fermenting organism (e.g., a yeast strain described herein) and a naturally occurring and/or a nonnaturally occurring component.

The fermenting organism described herein may be in any viable form, including crumbled, dry, including active dry and instant, compressed, cream (liquid) form etc. In one embodiment, the fermenting organism (e.g., a *Saccharomyces cerevisiae* yeast strain) is dry yeast, such as active dry yeast or instant yeast. In one embodiment, the fermenting organism (e.g., a *Saccharomyces cerevisiae* yeast strain) is crumbled yeast. In one embodiment, the fermenting organism (e.g., a *Saccharomyces cerevisiae* yeast strain) is compressed yeast. In one embodiment, the fermenting organism (e.g., a *Saccharomyces cerevisiae* yeast strain) is cream yeast.

In one embodiment is a composition comprising a fermenting organism described herein (e.g., a *Saccharomyces cerevisiae* yeast strain), and one or more of the component selected from the group consisting of: surfactants, emulsifiers, gums, swelling agent, and antioxidants and other processing aids.

The compositions described herein may comprise a fermenting organism described herein (e.g., a *Saccharomyces cerevisiae* yeast strain) and any suitable surfactants. In one embodiment, the surfactant(s) is/are an anionic surfactant, cationic surfactant, and/or nonionic surfactant.

The compositions described herein may comprise a fermenting organism described herein (e.g., a *Saccharomyces cerevisiae* yeast strain) and any suitable emulsifier. In one embodiment, the emulsifier is a fatty-acid ester of sorbitan. In one embodiment, the emulsifier is selected from the group of sorbitan monostearate (SMS), citric acid esters of mono-diglycerides, polyglycerolester, fatty acid esters of propylene glycol.

In one embodiment, the composition comprises a fermenting organism described herein (e.g., a *Saccharomyces cerevisiae* yeast strain), and Olindronal SMS, Olindronal SK, or Olindronal SPL including composition concerned in European Patent No. 1,724,336 (hereby incorporated by reference). These products are commercially available from Bussetti, Austria, for active dry yeast.

The compositions described herein may comprise a fermenting organism described herein (e.g., a *Saccharomyces cerevisiae* yeast strain) and any suitable gum. In one embodiment, the gum is selected from the group of carob, guar, tragacanth, arabic, xanthan and acacia gum, in particular for cream, compressed and dry yeast.

The compositions described herein may comprise a fermenting organism described herein (e.g., a *Saccharomyces cerevisiae* yeast strain) and any suitable swelling agent. In one embodiment, the swelling agent is methyl cellulose or carboxymethyl cellulose.

The compositions described herein may comprise a fermenting organism described herein (e.g., a *Saccharomyces cerevisiae* yeast strain) and any suitable anti-oxidant. In one embodiment, the antioxidant is butylated hydroxyanisol (BHA) and/or butylated hydroxytoluene (BHT), or ascorbic acid (vitamin C), particular for active dry yeast.

Gene Disruptions

The fermenting organisms described herein may also comprise one or more (e.g., two, several) gene disruptions, e.g., to divert sugar metabolism from undesired products to ethanol. In some aspects, the recombinant host cells produce a greater amount of ethanol compared to the cell without the one or more disruptions when cultivated under identical conditions. In some aspects, one or more of the disrupted endogenous genes is inactivated.

In certain embodiments, the fermenting organism provided herein comprises a disruption of one or more endogenous genes encoding enzymes involved in producing alternate fermentative products such as glycerol or other byproducts such as acetate or diols. For example, the cells provided herein may comprise a disruption of one or more of glycerol 3-phosphate dehydrogenase (GPD, catalyzes reaction of dihydroxyacetone phosphate to glycerol 3-phosphate), glycerol 3-phosphatase (GPP, catalyzes conversion of glycerol-3 phosphate to glycerol), glycerol kinase (catalyzes conversion of glycerol 3-phosphate to glycerol), dihydroxyacetone kinase (catalyzes conversion of dihydroxyacetone phosphate to dihydroxyacetone), glycerol dehydrogenase (catalyzes conversion of dihydroxyacetone to glycerol), and aldehyde dehydrogenase (ALD, e.g., converts acetaldehyde to acetate).

Modeling analysis can be used to design gene disruptions that additionally optimize utilization of the pathway. One exemplary computational method for identifying and designing metabolic alterations favoring biosynthesis of a desired product is the OptKnock computational framework, Burgard et al., 2003, *Biotechnol. Bioeng.* 84: 647-657.

The fermenting organisms comprising a gene disruption may be constructed using methods well known in the art, including those methods described herein. A portion of the gene can be disrupted such as the coding region or a control sequence required for expression of the coding region. Such a control sequence of the gene may be a promoter sequence or a functional part thereof, i.e., a part that is sufficient for affecting expression of the gene. For example, a promoter sequence may be inactivated resulting in no expression or a weaker promoter may be substituted for the native promoter sequence to reduce expression of the coding sequence. Other control sequences for possible modification include, but are not limited to, a leader, propeptide sequence, signal sequence, transcription terminator, and transcriptional activator.

The fermenting organisms comprising a gene disruption may be constructed by gene deletion techniques to eliminate or reduce expression of the gene. Gene deletion techniques enable the partial or complete removal of the gene thereby eliminating their expression. In such methods, deletion of the gene is accomplished by homologous recombination using a plasmid that has been constructed to contiguously contain the 5' and 3' regions flanking the gene.

The fermenting organisms comprising a gene disruption may also be constructed by introducing, substituting, and/or removing one or more (e.g., two, several) nucleotides in the gene or a control sequence thereof required for the transcription or translation thereof. For example, nucleotides may be inserted or removed for the introduction of a stop codon, the removal of the start codon, or a frame-shift of the open reading frame. Such a modification may be accomplished by site-directed mutagenesis or PCR generated mutagenesis in accordance with methods known in the art. See, for example, Botstein and Shortle, 1985, *Science* 229: 4719; Lo et al., 1985, *Proc. Natl. Acad. Sci. U.S.A.* 81: 2285; Higuchi et al., 1988, *Nucleic Acids Res* 16: 7351; Shimada, 1996, *Meth. Mol. Biol.* 57: 157; Ho et al., 1989, *Gene* 77: 61; Horton et al., 1989, *Gene* 77: 61; and Sarkar and Sommer, 1990, *BioTechniques* 8: 404.

The fermenting organisms comprising a gene disruption may also be constructed by inserting into the gene a disruptive nucleic acid construct comprising a nucleic acid fragment homologous to the gene that will create a duplication of the region of homology and incorporate construct DNA between the duplicated regions. Such a gene disruption can eliminate gene expression if the inserted construct separates the promoter of the gene from the coding region or interrupts the coding sequence such that a non-functional gene product results. A disrupting construct may be simply a selectable marker gene accompanied by 5' and 3' regions homologous to the gene. The selectable marker enables identification of transformants containing the disrupted gene.

The fermenting organisms comprising a gene disruption may also be constructed by the process of gene conversion (see, for example, Iglesias and Trautner, 1983, *Molecular General Genetics* 189: 73-76). For example, in the gene conversion method, a nucleotide sequence corresponding to the gene is mutagenized in vitro to produce a defective nucleotide sequence, which is then transformed into the recombinant strain to produce a defective gene. By homologous recombination, the defective nucleotide sequence replaces the endogenous gene. It may be desirable that the defective nucleotide sequence also comprises a marker for selection of transformants containing the defective gene.

The fermenting organisms comprising a gene disruption may be further constructed by random or specific mutagenesis using methods well known in the art, including, but not limited to, chemical mutagenesis (see, for example, Hopwood, *The Isolation of Mutants in Methods in Microbiology* (J. R. Norris and D. W. Ribbons, eds.) pp. 363-433, Academic Press, New York, 1970). Modification of the gene may be performed by subjecting the parent strain to mutagenesis and screening for mutant strains in which expression of the gene has been reduced or inactivated. The mutagenesis, which may be specific or random, may be performed, for example, by use of a suitable physical or chemical mutagenizing agent, use of a suitable oligonucleotide, or subjecting the DNA sequence to PCR generated mutagenesis. Furthermore, the mutagenesis may be performed by use of any combination of these mutagenizing methods.

Examples of a physical or chemical mutagenizing agent suitable for the present purpose include ultraviolet (UV) irradiation, hydroxylamine, N-methyl-N'-nitro-N-nitrosoguanidine (MNNG), N-methyl-N'-nitrosogaunidine (NTG) O-methyl hydroxylamine, nitrous acid, ethyl methane sulphonate (EMS), sodium bisulphite, formic acid, and nucleotide analogues. When such agents are used, the mutagenesis is typically performed by incubating the parent strain to be mutagenized in the presence of the mutagenizing agent of choice under suitable conditions, and selecting for mutants exhibiting reduced or no expression of the gene.

A nucleotide sequence homologous or complementary to a gene described herein may be used from other microbial sources to disrupt the corresponding gene in a recombinant strain of choice.

In one aspect, the modification of a gene in the recombinant cell is unmarked with a selectable marker. Removal of the selectable marker gene may be accomplished by culturing the mutants on a counter-selection medium. Where the selectable marker gene contains repeats flanking its 5' and 3' ends, the repeats will facilitate the looping out of the selectable marker gene by homologous recombination when the mutant strain is submitted to counter-selection. The selectable marker gene may also be removed by homologous recombination by introducing into the mutant strain a nucleic acid fragment comprising 5' and 3' regions of the defective gene, but lacking the selectable marker gene, followed by selecting on the counter-selection medium. By homologous recombination, the defective gene containing the selectable marker gene is replaced with the nucleic acid fragment lacking the selectable marker gene. Other methods known in the art may also be used.

Methods Using a Starch-Containing Material

In some aspects, the methods described herein produce a fermentation product from a starch-containing material. Starch-containing material is well-known in the art, containing two types of homopolysaccharides (amylose and amylopectin) and is linked by alpha-(1-4)-D-glycosidic bonds. Any suitable starch-containing starting material may be used. The starting material is generally selected based on the desired fermentation product, such as ethanol. Examples of starch-containing starting materials include cereal, tubers or grains. Specifically, the starch-containing material may be corn, wheat, barley, rye, milo, sago, cassava, tapioca, sorghum, oat, rice, peas, beans, or sweet potatoes, or mixtures thereof. Contemplated are also waxy and non-waxy types of corn and barley.

In one embodiment, the starch-containing starting material is corn. In one embodiment, the starch-containing starting material is wheat. In one embodiment, the starch-containing starting material is barley. In one embodiment, the starch-containing starting material is rye. In one embodiment, the starch-containing starting material is milo. In one embodiment, the starch-containing starting material is sago. In one embodiment, the starch-containing starting material is cassava. In one embodiment, the starch-containing starting material is tapioca. In one embodiment, the starch-containing starting material is sorghum. In one embodiment, the starch-containing starting material is rice. In one embodiment, the starch-containing starting material is peas. In one embodiment, the starch-containing starting material is beans. In one embodiment, the starch-containing starting material is sweet potatoes. In one embodiment, the starch-containing starting material is oats.

The methods using a starch-containing material may include a conventional process (e.g., including a liquefaction step described in more detail below) or a raw starch hydrolysis process. In some embodiments using a starch-containing material, saccarification of the starch-containing material is at a temperature above the initial gelatinization temperature. In some embodiments using a starch-containing material, saccarification of the starch-containing material is at a temperature below the initial gelatinization temperature.

Liquefaction

In aspects using a starch-containing material, the methods may further comprise a liquefaction step carried out by subjecting the starch-containing material at a temperature above the initial gelatinization temperature to an alpha-amylase and optionally a protease and/or a glucoamylase. Other enzymes such as a pullulanase and phytase may also be present and/or added in liquefaction. In some embodiments, the liquefaction step is carried out prior to steps a) and b) of the described methods.

Liquefaction step may be carried out for 0.5-5 hours, such as 1-3 hours, such as typically about 2 hours.

The term "initial gelatinization temperature" means the lowest temperature at which gelatinization of the starch-containing material commences. In general, starch heated in water begins to gelatinize between about 50° C. and 75° C.; the exact temperature of gelatinization depends on the specific starch and can readily be determined by the skilled artisan. Thus, the initial gelatinization temperature may vary according to the plant species, to the particular variety of the plant species as well as with the growth conditions. The initial gelatinization temperature of a given starch-containing material may be determined as the temperature at which birefringence is lost in 5% of the starch granules using the method described by Gorinstein and Lii, 1992, *Starch/Stärke* 44(12): 461-466.

Liquefaction is typically carried out at a temperature in the range from 70-100° C. In one embodiment, the temperature in liquefaction is between 75-95° C., such as between 75-90° C., between 80-90° C., or between 82-88° C., such as about 85° C.

A jet-cooking step may be carried out prior to liquefaction in step, for example, at a temperature between 110-145° C., 120-140° C., 125-135° C., or about 130° C. for about 1-15 minutes, for about 3-10 minutes, or about 5 minutes.

The pH during liquefaction may be between 4 and 7, such as pH 4.5-6.5, pH 5.0-6.5, pH 5.0-6.0, pH 5.2-6.2, or about 5.2, about 5.4, about 5.6, or about 5.8.

In one embodiment, the process further comprises, prior to liquefaction, the steps of:
  i) reducing the particle size of the starch-containing material, preferably by dry milling;
  ii) forming a slurry comprising the starch-containing material and water.

The starch-containing starting material, such as whole grains, may be reduced in particle size, e.g., by milling, in order to open up the structure, to increase surface area, and allowing for further processing. Generally, there are two types of processes: wet and dry milling. In dry milling whole kernels are milled and used. Wet milling gives a good separation of germ and meal (starch granules and protein). Wet milling is often applied at locations where the starch hydrolysate is used in production of, e.g., syrups. Both dry milling and wet milling are well known in the art of starch processing. In one embodiment the starch-containing material is subjected to dry milling. In one embodiment, the particle size is reduced to between 0.05 to 3.0 mm, e.g., 0.1-0.5 mm, or so that at least 30%, at least 50%, at least 70%, or at least 90% of the starch-containing material fit through a sieve with a 0.05 to 3.0 mm screen, e.g., 0.1-0.5 mm screen. In another embodiment, at least 50%, e.g., at least 70%, at least 80%, or at least 90% of the starch-containing material fit through a sieve with #6 screen.

The aqueous slurry may contain from 10-55 w/w-% dry solids (DS), e.g., 25-45 w/w-% dry solids (DS), or 30-40 w/w-% dry solids (DS) of starch-containing material.

The alpha-amylase, optionally a protease, and optionally a glucoamylase may initially be added to the aqueous slurry to initiate liquefaction (thinning). In one embodiment, only a portion of the enzymes (e.g., about ⅓) is added to the aqueous slurry, while the rest of the enzymes (e.g., about ⅔) are added during liquefaction step.

A non-exhaustive list of alpha-amylases used in liquefaction can be found below in the "Alpha-Amylases" section. Examples of suitable proteases used in liquefaction include any protease described supra in the "Proteases" section. Examples of suitable glucoamylases used in liquefaction include any glucoamylase found in the "Glucoamylases" section.

Saccharification and Fermentation of Starch-Containing Material

In aspects using a starch-containing material, a glucoamylase may be present and/or added in saccharification step a) and/or fermentation step b) or simultaneous saccharification and fermentation (SSF). The glucoamylase of the saccharification step a) and/or fermentation step b) or simultaneous saccharification and fermentation (SSF) is typically different from the glucoamylase optionally added to any liquefaction step described supra. In one embodiment, the glucoamylase is present and/or added together with a fungal alpha-amylase.

In some aspects, the fermenting organism comprises a heterologous polynucleotide encoding a glucoamylase, for example, as described in WO2017/087330, the content of which is hereby incorporated by reference.

Examples of glucoamylases can be found in the "Glucoamylases" section below.

When doing sequential saccharification and fermentation, saccharification step a) may be carried out under conditions well-known in the art. For instance, saccharification step a) may last up to from about 24 to about 72 hours. In one embodiment, pre-saccharification is done. Pre-saccharification is typically done for 40-90 minutes at a temperature between 30-65° C., typically about 60° C. Pre-saccharification is, in one embodiment, followed by saccharification during fermentation in simultaneous saccharification and fermentation (SSF). Saccharification is typically carried out at temperatures from 20-75° C., preferably from 40-70° C., typically about 60° C., and typically at a pH between 4 and 5, such as about pH 4.5.

Fermentation is carried out in a fermentation medium, as known in the art and, e.g., as described herein. The fermentation medium includes the fermentation substrate, that is, the carbohydrate source that is metabolized by the fermenting organism. With the processes described herein, the fermentation medium may comprise nutrients and growth stimulator(s) for the fermenting organism(s). Nutrient and growth stimulators are widely used in the art of fermentation and include nitrogen sources, such as ammonia; urea, vitamins and minerals, or combinations thereof.

Generally, fermenting organisms such as yeast, including *Saccharomyces cerevisiae* yeast, require an adequate source of nitrogen for propagation and fermentation. Many sources of supplemental nitrogen, if necessary, can be used and such sources of nitrogen are well known in the art. The nitrogen source may be organic, such as urea, DDGs, wet cake or corn mash, or inorganic, such as ammonia or ammonium hydroxide. In one embodiment, the nitrogen source is urea.

Fermentation can be carried out under low nitrogen conditions, e.g., when using a protease-expressing yeast. In some embodiments, the fermentation step is conducted with less than 1000 ppm supplemental nitrogen (e.g., urea or ammonium hydroxide), such as less than 750 ppm, less than 500 ppm, less than 400 ppm, less than 300 ppm, less than 250 ppm, less than 200 ppm, less than 150 ppm, less than 100 ppm, less than 75 ppm, less than 50 ppm, less than 25 ppm, or less than 10 ppm, supplemental nitrogen. In some embodiments, the fermentation step is conducted with no supplemental nitrogen.

Simultaneous saccharification and fermentation ("SSF") is widely used in industrial scale fermentation product production processes, especially ethanol production processes. When doing SSF the saccharification step a) and the fermentation step b) are carried out simultaneously. There is no holding stage for the saccharification, meaning that a fermenting organism, such as yeast, and enzyme(s), may be added together. However, it is also contemplated to add the fermenting organism and enzyme(s) separately. SSF is typically carried out at a temperature from 25° C. to 40° C., such as from 28° C. to 35° C., such as from 30° C. to 34° C., or about 32° C. In one embodiment, fermentation is ongoing for 6 to 120 hours, in particular 24 to 96 hours. In one embodiment, the pH is between 4-5.

In one embodiment, a cellulolytic enzyme composition is present and/or added in saccharification, fermentation or simultaneous saccharification and fermentation (SSF). Examples of such cellulolytic enzyme compositions can be found in the "Cellulolytic Enzymes and Compositions" section below. The cellulolytic enzyme composition may be present and/or added together with a glucoamylase, such as one disclosed in the "Glucoamylases" section below.

Alpha-Amylases

The expressed and/or exogenous alpha-amylase may be any alpha-amylase that is suitable for the host cells and/or the methods described herein, such as a naturally occurring alpha-amylase (e.g., a native alpha-amylase from another species or an endogenous alpha-amylase expressed from a modified expression vector) or a variant thereof that retains alpha-amylase activity. Any alpha-amylase contemplated for expression by a fermenting organism described below is also contemplated for aspects of the invention involving exogenous addition of an alpha-amylase.

In some embodiments, the fermenting organism comprises a heterologous polynucleotide encoding an alpha-amylase, for example, as described in WO2017/087330, the content of which is hereby incorporated by reference. Any alpha-amylase described or referenced herein is contemplated for expression in the fermenting organism.

In some embodiments, the fermenting organism comprising a heterologous polynucleotide encoding an alpha-amylase has an increased level of alpha-amylase activity compared to the host cells without the heterologous polynucleotide encoding the alpha-amylase, when cultivated under the same conditions. In some embodiments, the fermenting organism has an increased level of alpha-amylase activity of at least 5%, e.g., at least 10%, at least 15%, at least 20%, at least 25%, at least 50%, at least 100%, at least 150%, at least 200%, at least 300%, or at 500% compared to the fermenting organism without the heterologous polynucleotide encoding the alpha-amylase, when cultivated under the same conditions.

Exemplary alpha-amylases that can be used with the host cells and/or the methods described herein include bacterial, yeast, or filamentous fungal alpha-amylases, e.g., derived from any of the microorganisms described or referenced herein.

The term "bacterial alpha-amylase" means any bacterial alpha-amylase classified under EC 3.2.1.1. A bacterial alpha-amylase used herein may, e.g., be derived from a strain of the genus *Bacillus*, which is sometimes also referred to as the genus *Geobacillus*. In one embodiment, the *Bacillus* alpha-amylase is derived from a strain of *Bacillus amyloliquefaciens*, *Bacillus licheniformis*, *Bacillus stearothermophilus*, or *Bacillus subtilis*, but may also be derived from other *Bacillus* sp.

Specific examples of bacterial alpha-amylases include the *Bacillus stearothermophilus* alpha-amylase (BSG) of SEQ ID NO: 3 in WO99/19467, the *Bacillus amyloliquefaciens* alpha-amylase (BAN) of SEQ ID NO: 5 in WO99/19467, and the *Bacillus licheniformis* alpha-amylase (BLA) of SEQ ID NO: 4 in WO99/19467 (all sequences are hereby incorporated by reference).

In one embodiment, the alpha-amylase may be an enzyme having a mature polypeptide sequence with a degree of identity of at least 60%, e.g., at least 70%, at least 80%, at least 90%, at least 95%, at least 96%, at least 97%, at least 98% or at least 99% to any of the sequences shown in SEQ ID NOs: 3, 4 or 5, in WO99/19467.

In one embodiment, the alpha-amylase is derived from *Bacillus stearothermophilus*. The *Bacillus stearothermophilus* alpha-amylase may be a mature wild-type or a mature variant thereof. The mature *Bacillus stearothermophilus* alpha-amylases may naturally be truncated during recombinant production. For instance, the *Bacillus stearothermophilus* alpha-amylase may be a truncated at the C-terminal, so that it is from 480-495 amino acids long, such as about 491 amino acids long, e.g., so that it lacks a functional starch binding domain (compared to SEQ ID NO: 3 in WO99/19467).

The *Bacillus* alpha-amylase may also be a variant and/or hybrid. Examples of such a variant can be found in any of WO96/23873, WO96/23874, WO97/41213, WO99/19467, WO00/60059, and WO02/10355 (each hereby incorporated by reference). Specific alpha-amylase variants are disclosed in U.S. Pat. Nos. 6,093,562, 6,187,576, 6,297,038, and 7,713,723 (hereby incorporated by reference) and include *Bacillus stearothermophilus* alpha-amylase (often referred to as BSG alpha-amylase) variants having a deletion of one or two amino acids at positions R179, G180, I181 and/or G182, preferably a double deletion disclosed in WO96/23873—see, e.g., page 20, lines 1-10 (hereby incorporated by reference), such as corresponding to deletion of positions I181 and G182 compared to the amino acid sequence of *Bacillus stearothermophilus* alpha-amylase set forth in SEQ ID NO: 3 disclosed in WO99/19467 or the deletion of amino acids R179 and G180 using SEQ ID NO: 3 in WO99/19467 for numbering (which reference is hereby incorporated by reference). In some embodiments, the *Bacillus* alpha-amylases, such as *Bacillus stearothermophilus* alpha-amylases, have a double deletion corresponding to a deletion of positions 181 and 182 and further optionally comprise a N193F substitution (also denoted I181*+G182*+N193F) compared to the wild-type BSG alpha-amylase amino acid sequence set forth in SEQ ID NO: 3 disclosed in WO99/19467. The bacterial alpha-amylase may also have a substitution in a position corresponding to S239 in the *Bacillus licheniformis* alpha-amylase shown in SEQ ID NO: 4 in WO99/19467, or a S242 and/or E188P variant of the *Bacillus stearothermophilus* alpha-amylase of SEQ ID NO: 3 in WO99/19467.

In one embodiment, the variant is a S242A, E or Q variant, e.g., a S242Q variant, of the *Bacillus stearothermophilus* alpha-amylase.

In one embodiment, the variant is a position E188 variant, e.g., E188P variant of the *Bacillus stearothermophilus* alpha-amylase.

The bacterial alpha-amylase may, in one embodiment, be a truncated *Bacillus* alpha-amylase. In one embodiment, the truncation is so that, e.g., the *Bacillus stearothermophilus* alpha-amylase shown in SEQ ID NO: 3 in WO99/19467, is about 491 amino acids long, such as from 480 to 495 amino acids long, or so it lacks a functional starch bind domain.

The bacterial alpha-amylase may also be a hybrid bacterial alpha-amylase, e.g., an alpha-amylase comprising 445 C-terminal amino acid residues of the *Bacillus licheniformis* alpha-amylase (shown in SEQ ID NO: 4 of WO99/19467) and the 37 N-terminal amino acid residues of the alpha-amylase derived from *Bacillus amyloliquefaciens* (shown in SEQ ID NO: 5 of WO99/19467). In one embodiment, this hybrid has one or more, especially all, of the following substitutions: G48A+T49I+G107A+H156Y+A181T+N190F+I201F+A209V+Q264S (using the *Bacillus licheniformis* numbering in SEQ ID NO: 4 of WO99/19467). In some embodiments, the variants have one or more of the following mutations (or corresponding mutations in other *Bacillus* alpha-amylases): H154Y, A181T, N190F, A209V and Q264S and/or the deletion of two residues between positions 176 and 179, e.g., deletion of E178 and G179 (using SEQ ID NO: 5 of WO99/19467 for position numbering).

In one embodiment, the bacterial alpha-amylase is the mature part of the chimeric alpha-amylase disclosed in Richardson et al. (2002), *The Journal of Biological Chemistry*, Vol. 277, No 29, Issue 19 July, pp. 267501-26507, referred to as BD5088 or a variant thereof. This alpha-amylase is the same as the one shown in SEQ ID NO: 2 in WO2007/134207. The mature enzyme sequence starts after the initial "Met" amino acid in position 1.

The alpha-amylase may be a thermostable alpha-amylase, such as a thermostable bacterial alpha-amylase, e.g., from *Bacillus stearothermophilus*. In one embodiment, the alpha-amylase used in a process described herein has a T½ (min) at pH 4.5, 85° C., 0.12 mM CaCl$_2$ of at least 10 determined as described in Example 1 of WO2018/098381.

In one embodiment, the thermostable alpha-amylase has a T½ (min) at pH 4.5, 85° C., 0.12 mM CaCl$_2$, of at least 15. In one embodiment, the thermostable alpha-amylase has a T % (min) at pH 4.5, 85° C., 0.12 mM CaCl$_2$, of as at least 20. In one embodiment, the thermostable alpha-amylase has a T½ (min) at pH 4.5, 85° C., 0.12 mM CaCl$_2$, of as at least 25. In one embodiment, the thermostable alpha-amylase has a T½ (min) at pH 4.5, 85° C., 0.12 mM CaCl$_2$, of as at least 30. In one embodiment, the thermostable alpha-amylase has a T½ (min) at pH 4.5, 85° C., 0.12 mM CaCl$_2$, of as at least 40.

In one embodiment, the thermostable alpha-amylase has a T½ (min) at pH 4.5, 85° C., 0.12 mM CaCl$_2$, of at least 50. In one embodiment, the thermostable alpha-amylase has a T % (min) at pH 4.5, 85° C., 0.12 mM CaCl$_2$, of at least 60. In one embodiment, the thermostable alpha-amylase has a T½ (min) at pH 4.5, 85° C., 0.12 mM CaCl$_2$, between 10-70. In one embodiment, the thermostable alpha-amylase has a T½ (min) at pH 4.5, 85° C., 0.12 mM CaCl$_2$, between 15-70. In one embodiment, the thermostable alpha-amylase has a T½ (min) at pH 4.5, 85° C., 0.12 mM CaCl$_2$, between 20-70. In one embodiment, the thermostable alpha-amylase has a T½ (min) at pH 4.5, 85° C., 0.12 mM CaCl$_2$, between 25-70. In one embodiment, the thermostable alpha-amylase has a T½ (min) at pH 4.5, 85° C., 0.12 mM CaCl$_2$, between 30-70. In one embodiment, the thermostable alpha-amylase has a T½ (min) at pH 4.5, 85° C., 0.12 mM CaCl$_2$, between 40-70. In one embodiment, the thermostable alpha-amylase has a T½ (min) at pH 4.5, 85° C., 0.12 mM CaCl$_2$, between 50-70. In one embodiment, the thermostable alpha-amylase has a T½ (min) at pH 4.5, 85° C., 0.12 mM CaCl$_2$, between 60-70.

In one embodiment, the alpha-amylase is a bacterial alpha-amylase, e.g., derived from the genus *Bacillus*, such as a strain of *Bacillus stearothermophilus*, e.g., the *Bacillus stearothermophilus* as disclosed in WO99/019467 as SEQ ID NO: 3 with one or two amino acids deleted at positions R179, G180, I181 and/or G182, in particular with R179 and G180 deleted, or with I181 and G182 deleted, with mutations in below list of mutations.

In some embodiment, the *Bacillus stearothermophilus* alpha-amylases have double deletion I181+G182, and optional substitution N193F, further comprising one of the following substitutions or combinations of substitutions:

V59A+Q89R+G112D+E129V+K177L+R179E+K220P+ N224L+Q254S;
V59A+Q89R+E129V+K177L+R179E+H208Y+K220P+ N224L+Q254S;
V59A+Q89R+E129V+K177L+R179E+K220P+N224L+ Q254S+D269E+D281N;
V59A+Q89R+E129V+K177L+R179E+K220P+N224L+ Q254S+I270L;
V59A+Q89R+E129V+K177L+R179E+K220P+N224L+ Q254S+H274K;
V59A+Q89R+E129V+K177L+R179E+K220P+N224L+ Q254S+Y276F;
V59A+E129V+R157Y+K177L+R179E+K220P+ N224L+S242Q+Q254S;
V59A+E129V+K177L+R179E+H208Y+K220P+ N224L+S242Q+Q254S;
V59A+E129V+K177L+R179E+K220P+N224L+ S242Q+Q254S;
V59A+E129V+K177L+R179E+K220P+N224L+ S242Q+Q254S+H274K;
V59A+E129V+K177L+R179E+K220P+N224L+ S242Q+Q254S+Y276F;
V59A+E129V+K177L+R179E+K220P+N224L+ S242Q+Q254S+D281 N;
V59A+E129V+K177L+R179E+K220P+N224L+ S242Q+Q254S+M284T;
V59A+E129V+K177L+R179E+K220P+N224L+ S242Q+Q254S+G416V;
V59A+E129V+K177L+R179E+K220P+N224L+Q254S;
V59A+E129V+K177L+R179E+K220P+N224L+ Q254S+M284T;
A91L+M961+E129V+K177L+R179E+K220P+N224L+ S242Q+Q254S;
E129V+K177L+R179E;
E129V+K177L+R179E+K220P+N224L+S242Q+ Q254S;
E129V+K177L+R179E+K220P+N224L+S242Q+ Q254S+Y276F+L427M;
E129V+K177L+R179E+K220P+N224L+S242Q+ Q254S+M284T;
E129V+K177L+R179E+K220P+N224L+S242Q+ Q254S+N376*+1377*;
E129V+K177L+R179E+K220P+N224L+Q254S;
E129V+K177L+R179E+K220P+N224L+Q254S+ M284T;
E129V+K177L+R179E+S242Q;
E129V+K177L+R179V+K220P+N224L+S242Q+ Q254S;
K220P+N224L+S242Q+Q254S;
M284V;
V59A+Q89R+E129V+K177L+R179E+Q254S+M284V; and
V59A+E129V+K177L+R179E+Q254S+M284V;

In one embodiment, the alpha-amylase is selected from the group of *Bacillus stearothermophilus* alpha-amylase variants with double deletion 1181*+G182*, and optionally substitution N193F, and further one of the following substitutions or combinations of substitutions:

E129V+K177L+R179E;
V59A+Q89R+E129V+K177L+R179E+H208Y+K220P+ N224L+Q254S;
V59A+Q89R+E129V+K177L+R179E+Q254S+M284V;
V59A+E129V+K177L+R179E+Q254S+M284V; and
E129V+K177L+R179E+K220P+N224L+S242Q+Q254S
(using SEQ ID NO: 1 herein for numbering).

It should be understood that when referring to *Bacillus stearothermophilus* alpha-amylase and variants thereof they are normally produced in truncated form. In particular, the truncation may be so that the *Bacillus stearothermophilus* alpha-amylase shown in SEQ ID NO: 3 in WO99/19467, or variants thereof, are truncated in the C-terminal and are typically from 480-495 amino acids long, such as about 491 amino acids long, e.g., so that it lacks a functional starch binding domain.

In one embodiment, the alpha-amylase variant may be an enzyme having a mature polypeptide sequence with a degree of identity of at least 60%, e.g., at least 70%, at least 80%, at least 90%, at least 95%, at least 91%, at least 92%, at least 93%, at least 94%, at least 95%, at least 96%, at least 97%, at least 98% or at least 99%, but less than 100% to the sequence shown in SEQ ID NO: 3 in WO99/19467.

In one embodiment, the bacterial alpha-amylase, e.g., *Bacillus* alpha-amylase, such as especially *Bacillus stearothermophilus* alpha-amylase, or variant thereof, is dosed to liquefaction in a concentration between 0.01-10 KNU-A/g DS, e.g., between 0.02 and 5 KNU-A/g DS, such as 0.03 and 3 KNU-A, preferably 0.04 and 2 KNU-A/g DS, such as especially 0.01 and 2 KNU-A/g DS. In one embodiment, the bacterial alpha-amylase, e.g., *Bacillus* alpha-amylase, such as especially *Bacillus stearothermophilus* alpha-amylases, or variant thereof, is dosed to liquefaction in a concentration of between 0.0001-1 mg EP (Enzyme Protein)/g DS, e.g., 0.0005-0.5 mg EP/g DS, such as 0.001-0.1 mg EP/g DS.

In one embodiment, the bacterial alpha-amylase is derived from the *Bacillus subtilis* alpha-amylase of SEQ ID NO: 76, the *Bacillus subtilis* alpha-amylase of SEQ ID NO: 82, the *Bacillus subtilis* alpha-amylase of SEQ ID NO: 83, the *Bacillus subtilis* alpha-amylase of SEQ ID NO: 84, or the *Bacillus licheniformis* alpha-amylase of SEQ ID NO: 85, the *Clostridium phytofermentans* alpha-amylase of SEQ ID NO: 89, the *Clostridium phytofermentans* alpha-amylase of SEQ ID NO: 90, the *Clostridium phytofermentans* alpha-amylase of SEQ ID NO: 91, the *Clostridium phytofermentans* alpha-amylase of SEQ ID NO: 92, the *Clostridium phytofermentans* alpha-amylase of SEQ ID NO: 93, the *Clostridium phytofermentans* alpha-amylase of SEQ ID NO: 94, the *Clostridium thermocellum* alpha-amylase of SEQ ID NO: 95, the *Thermobifida fusca* alpha-amylase of SEQ ID NO: 96, the *Thermobifida fusca* alpha-amylase of SEQ ID NO: 97, the *Anaerocellum thermophilum* of SEQ ID NO: 98, the *Anaerocellum thermophilum* of SEQ ID NO: 99, the *Anaerocellum thermophilum* of SEQ ID NO: 100, the *Streptomyces avermitilis* of SEQ ID NO: 101, or the *Streptomyces avermitilis* of SEQ ID NO: 88.

In one embodiment, the alpha-amylase is derived from *Bacillus amyloliquefaciens*, such as the *Bacillus amyloliquefaciens* alpha-amylase of SEQ ID NO: 231 (e.g., as described in WO2018/002360, or variants thereof as described in WO2017/037614).

In one embodiment, the alpha-amylase is derived from a yeast alpha-amylase, such as the *Saccharomycopsis fibuligera* alpha-amylase of SEQ ID NO: 77, the *Debaryomyces occidentalis* alpha-amylase of SEQ ID NO: 78, the *Debaryomyces occidentalis* alpha-amylase of SEQ ID NO: 79, the *Lipomyces kononenkoae* alpha-amylase of SEQ ID NO: 80, the *Lipomyces kononenkoae* alpha-amylase of SEQ ID NO: 81.

In one embodiment, the alpha-amylase is derived from a filamentous fungal alpha-amylase, such as the *Aspergillus niger* alpha-amylase of SEQ ID NO: 86, or the *Aspergillus niger* alpha-amylase of SEQ ID NO: 87.

Additional alpha-amylases that may be expressed with the fermenting organisms and used with the methods described herein are described in the examples, and include, but are not limited to alpha-amylases shown in Table 1 (or derivatives thereof).

TABLE 1

| Donor Organism (catalytic domain) | SEQ ID NO: (mature polypeptide) |
|---|---|
| Rhizomucor pusillus | 121 |
| Bacillus licheniformis | 122 |
| Aspergillus niger | 123 |
| Aspergillus tamarii | 124 |
| Acidomyces richmondensis | 125 |
| Aspergillus bombycis | 126 |
| Alternaria sp | 127 |
| Rhizopus microsporus | 128 |
| Syncephalastrum racemosum | 129 |
| Rhizomucor pusillus | 130 |
| Dichotomocladium hesseltinei | 131 |
| Lichtheimia ramosa | 132 |
| Penicillium aethiopicum | 133 |
| Subulispora sp | 134 |
| Trichoderma paraviridescens | 135 |
| Byssoascus striatosporus | 136 |
| Aspergillus brasiliensis | 137 |
| Penicillium subspinulosum | 138 |
| Penicillium antarcticum | 139 |
| Penicillium coprophilum | 140 |
| Penicillium olsonii | 141 |
| Penicillium vasconiae | 142 |
| Penicillium sp | 143 |
| Heterocephalum aurantiacum | 144 |
| Neosartorya massa | 145 |
| Penicillium janthinellum | 146 |
| Aspergillus brasiliensis | 147 |
| Aspergillus westerdijkiae | 148 |
| Hamigera avellanea | 149 |
| Hamigera avellanea | 150 |
| Meripilus giganteus | 151 |
| Cerrena unicolor | 152 |
| Physalacria cryptomeriae | 153 |
| Lenzites betulinus | 154 |
| Trametes ljubarskyi | 155 |
| Bacillus subtilis | 156 |
| Bacillus subtilis subsp. subtilis | 157 |
| Schwanniomyces occidentalis | 158 |
| Rhizomucor pusillus | 159 |
| Aspergillus niger | 160 |
| Bacillus stearothermophilus | 161 |
| Bacillus halmapalus | 162 |
| Aspergillus oryzae | 163 |
| Bacillus amyloliquefaciens | 164 |
| Rhizomucor pusillus | 165 |
| Kionochaeta ivoriensis | 166 |
| Aspergillus niger | 167 |
| Aspergillus oryzae | 168 |
| Penicillium canescens | 169 |
| Acidomyces acidothermus | 170 |
| Kinochaeta ivoriensis | 171 |
| Aspergillus terreus | 172 |
| Thamnidium elegans | 173 |
| Meripilus giganteus | 174 |

Additional alpha-amylases contemplated for use with the present invention can be found in WO2011/153516 (the content of which is incorporated herein).

Additional polynucleotides encoding suitable alpha-amylases may be obtained from microorganisms of any genus, including those readily available within the UniProtKB database (www.uniprot.org).

As described supra, the alpha-amylase may be a bacterial alpha-amylase. For example, the alpha-amylase may be derived from a Gram-positive bacterium such as a *Bacillus*, *Clostridium*, *Enterococcus*, *Geobacillus*, *Lactobacillus*, *Lactococcus*, *Oceanobacillus*, *Staphylococcus*, *Streptococcus*, or *Streptomyces*, or a Gram-negative bacterium such as a *Campylobacter*, *E. coli*, *Flavobacterium*, *Fusobacterium*, *Helicobacter*, *Ilyobacter*, *Neisseria*, *Pseudomonas*, *Salmonella*, or *Ureaplasma*.

In one embodiment, the alpha-amylase is derived from *Bacillus alkalophilus*, *Bacillus amyloliquefaciens*, *Bacillus brevis*, *Bacillus circulans*, *Bacillus clausii*, *Bacillus coagulans*, *Bacillus firmus*, *Bacillus lautus*, *Bacillus lentus*, *Bacillus licheniformis*, *Bacillus megaterium*, *Bacillus pumilus*, *Bacillus stearothermophilus*, *Bacillus subtilis*, or *Bacillus thuringiensis*.

In another embodiment, the alpha-amylase is derived from *Streptococcus equisimilis*, *Streptococcus pyogenes*, *Streptococcus uberis*, or *Streptococcus equi* subsp. *Zooepidemicus*.

In another embodiment, the alpha-amylase is derived from *Streptomyces achromogenes*, *Streptomyces avermitilis*, *Streptomyces coelicolor*, *Streptomyces griseus*, or *Streptomyces lividans*.

The alpha-amylase may be a fungal alpha-amylase. For example, the alpha-amylase may be derived from a yeast such as a *Candida*, *Kluyveromyces*, *Pichia*, *Saccharomyces*, *Schizosaccharomyces*, *Yarrowia* or *Issatchenkia*; or derived from a filamentous fungus such as an *Acremonium*, *Agaricus*, *Alternaria*, *Aspergillus*, *Aureobasidium*, *Botryosphaeria*, *Ceriporiopsis*, *Chaetomidium*, *Chrysosporium*, *Claviceps*, *Cochliobolus*, *Coprinopsis*, *Coptotermes*, *Corynascus*, *Cryphonectria*, *Cryptococcus*, *Diplodia*, *Exidia*, *Filibasidium*, *Fusarium*, *Gibberella*, *Holomastigotoides*, *Humicola*, *Irpex*, *Lentinula*, *Leptospaeria*, *Magnaporthe*, *Melanocarpus*, *Meripilus*, *Mucor*, *Myceliophthora*, *Neocallimastix*, *Neurospora*, *Paecilomyces*, *Penicillium*, *Phanerochaete*, *Piromyces*, *Poitrasia*, *Pseudoplectania*, *Pseudotrichonympha*, *Rhizomucor*, *Schizophyllum*, *Scytalidium*, *Talaromyces*, *Thermoascus*, *Thielavia*, *Tolypocladium*, *Trichoderma*, *Trichophaea*, *Verticillium*, *Volvariella*, or *Xylaria*.

In another embodiment, the alpha-amylase is derived from *Saccharomyces carlsbergensis*, *Saccharomyces cerevisiae*, *Saccharomyces diastaticus*, *Saccharomyces douglasii*, *Saccharomyces kluyveri*, *Saccharomyces norbensis*, or *Saccharomyces oviformis*.

In another embodiment, the alpha-amylase is derived from *Acremonium cellulolyticus*, *Aspergillus aculeatus*, *Aspergillus awamori*, *Aspergillus foetidus*, *Aspergillus fumigatus*, *Aspergillus japonicus*, *Aspergillus nidulans*, *Aspergillus niger*, *Aspergillus oryzae*, *Chrysosporium inops*, *Chrysosporium keratinophilum*, *Chrysosporium lucknowense*, *Chrysosporium merdarium*, *Chrysosporium pannicola*, *Chrysosporium queenslandicum*, *Chrysosporium tropicum*, *Chrysosporium zonatum*, *Fusarium bactridioides*, *Fusarium cerealis*, *Fusarium crookwellense*, *Fusarium culmorum*, *Fusarium graminearum*, *Fusarium graminum*, *Fusarium heterosporum*, *Fusarium negundi*, *Fusarium oxysporum*, *Fusarium reticulatum*, *Fusarium roseum*, *Fusarium sambucinum*, *Fusarium sarcochroum*, *Fusarium sporotrichioides*, *Fusarium suiphureum*, *Fusarium torulosum*, *Fusarium trichothecioides*, *Fusarium venenatum*, *Humicola grisea*, *Humicola insolens*, *Humicola lanuginosa*, *Irpex lacteus*, *Mucor miehei*, *Myceliophthora thermophila*, *Neurospora crassa*, *Penicillium funiculosum*, *Penicillium purpurogenum*, *Phanerochaete chrysosporium*, *Thielavia achromatica*, *Thielavia albomyces*, *Thielavia albopilosa*, *Thielavia australeinsis*, *Thielavia fimeti*, *Thielavia microspora*, *Thielavia ovispora*, *Thielavia peruviana*, *Thielavia setosa*, *Thielavia spededonium*, *Thielavia subthermophila*, *Thielavia terrestris*, *Trichoderma harzianum*,

*Trichoderma koningii, Trichoderma longibrachiatum, Trichoderma reesei,* or *Trichoderma viride.*

It will be understood that for the aforementioned species, the invention encompasses both the perfect and imperfect states, and other taxonomic equivalents, e.g., anamorphs, regardless of the species name by which they are known. Those skilled in the art will readily recognize the identity of appropriate equivalents.

Strains of these species are readily accessible to the public in a number of culture collections, such as the American Type Culture Collection (ATCC), Deutsche Sammlung von Mikroorganismen und Zellkulturen GmbH (DSMZ), Centraalbureau Voor Schimmelcultures (CBS), and Agricultural Research Service Patent Culture Collection, Northern Regional Research Center (NRRL).

The alpha-amylase coding sequences described or referenced herein, or a subsequence thereof, as well as the alpha-amylases described or referenced herein, or a fragment thereof, may be used to design nucleic acid probes to identify and clone DNA encoding an alpha-amylase from strains of different genera or species according to methods well known in the art. In particular, such probes can be used for hybridization with the genomic DNA or cDNA of a cell of interest, following standard Southern blotting procedures, in order to identify and isolate the corresponding gene therein. Such probes can be considerably shorter than the entire sequence, but should be at least 15, e.g., at least 25, at least 35, or at least 70 nucleotides in length. Preferably, the nucleic acid probe is at least 100 nucleotides in length, e.g., at least 200 nucleotides, at least 300 nucleotides, at least 400 nucleotides, at least 500 nucleotides, at least 600 nucleotides, at least 700 nucleotides, at least 800 nucleotides, or at least 900 nucleotides in length. Both DNA and RNA probes can be used. The probes are typically labeled for detecting the corresponding gene (for example, with $^{32}P$, $^{3}H$, $^{35}S$, biotin, or avidin).

A genomic DNA or cDNA library prepared from such other strains may be screened for DNA that hybridizes with the probes described above and encodes a parent. Genomic or other DNA from such other strains may be separated by agarose or polyacrylamide gel electrophoresis, or other separation techniques. DNA from the libraries or the separated DNA may be transferred to and immobilized on nitrocellulose or other suitable carrier material. In order to identify a clone or DNA that hybridizes with a coding sequence, or a subsequence thereof, the carrier material is used in a Southern blot.

In one embodiment, the nucleic acid probe is a polynucleotide, or subsequence thereof, that encodes the alpha-amylase of any one of SEQ ID NOs: 76-101, 121-174 and 231, or a fragment thereof.

For purposes of the probes described above, hybridization indicates that the polynucleotide hybridizes to a labeled nucleic acid probe, or the full-length complementary strand thereof, or a subsequence of the foregoing; under very low to very high stringency conditions. Molecules to which the nucleic acid probe hybridizes under these conditions can be detected using, for example, X-ray film. Stringency and washing conditions are defined as described supra.

In one embodiment, the alpha-amylase is encoded by a polynucleotide that hybridizes under at least low stringency conditions, e.g., medium stringency conditions, medium-high stringency conditions, high stringency conditions, or very high stringency conditions with the full-length complementary strand of the coding sequence for any one of the alpha-amylases described or referenced herein (e.g., the coding sequence that encodes any one of SEQ ID NOs: 76-101, 121-174 and 231). (Sambrook et al., 1989, *Molecular Cloning, A Laboratory Manual,* 2d edition, Cold Spring Harbor, New York).

The alpha-amylase may also be identified and obtained from other sources including microorganisms isolated from nature (e.g., soil, composts, water, silage, etc.) or DNA samples obtained directly from natural materials (e.g., soil, composts, water, silage, etc.) using the above-mentioned probes. Techniques for isolating microorganisms and DNA directly from natural habitats are well known in the art. The polynucleotide encoding a alpha-amylase may then be derived by similarly screening a genomic or cDNA library of another microorganism or mixed DNA sample.

Once a polynucleotide encoding an alpha-amylase has been detected with a suitable probe as described herein, the sequence may be isolated or cloned by utilizing techniques that are known to those of ordinary skill in the art (see, e.g., Sambrook et al., 1989, *Molecular Cloning, A Laboratory Manual,* 2d edition, Cold Spring Harbor, New York). Techniques used to isolate or clone polynucleotides encoding alpha-amylases include isolation from genomic DNA, preparation from cDNA, or a combination thereof. The cloning of the polynucleotides from such genomic DNA can be effected, e.g., by using the well-known polymerase chain reaction (PCR) or antibody screening of expression libraries to detect cloned DNA fragments with shares structural features. See, e.g., Innis et al., 1990, *PCR: A Guide to Methods and Application,* Academic Press, New York. Other nucleic acid amplification procedures such as ligase chain reaction (LCR), ligated activated transcription (LAT) and nucleotide sequence-based amplification (NASBA) may be used.

In one embodiment, the alpha-amylase has a mature polypeptide sequence that comprises or consists of the amino acid sequence of any one of the alpha-amylases described or referenced herein (e.g., any one of SEQ ID NOs: 76-101, 121-174 and 231). In another embodiment, the alpha-amylase has a mature polypeptide sequence that is a fragment of the any one of the alpha-amylases described or referenced herein (e.g., any one of SEQ ID NOs: 76-101, 121-174 and 231). In one embodiment, the number of amino acid residues in the fragment is at least 75%, e.g., at least 80%, 85%, 90%, or 95% of the number of amino acid residues in referenced full length alpha-amylase (e.g. any one of SEQ ID NOs: 76-101, 121-174 and 231). In other embodiments, the alpha-amylase may comprise the catalytic domain of any alpha-amylase described or referenced herein (e.g., the catalytic domain of any one of SEQ ID NOs: 76-101, 121-174 and 231).

The alpha-amylase may be a variant of any one of the alpha-amylases described supra (e.g., any one of SEQ ID NOs: 76-101, 121-174 and 231). In one embodiment, the alpha-amylase has a mature polypeptide sequence of at least 60%, e.g., at least 65%, 70%, 75%, 80%, 85%, 90%, 95%, 97%, 98%, 99%, or 100% sequence identity to any one of the alpha-amylases described supra (e.g., any one of SEQ ID NOs: 76-101, 121-174 and 231).

In one embodiment, the alpha-amylase has a mature polypeptide sequence that differs by no more than ten amino acids, e.g., by no more than five amino acids, by no more than four amino acids, by no more than three amino acids, by no more than two amino acids, or by one amino acid from the amino acid sequence of any one of the alpha-amylases described supra (e.g., any one of SEQ ID NOs: 76-101, 121-174 and 231). In one embodiment, the alpha-amylase has an amino acid substitution, deletion, and/or insertion of one or more (e.g., two, several) of amino acid sequence of any one of the alpha-amylases described supra (e.g., any one of SEQ ID NOs: 76-101, 121-174 and 231). In some embodiments, the total number of amino acid substitutions, deletions and/or insertions is not more than 10, e.g., not more than 9, 8, 7, 6, 5, 4, 3, 2, or 1.

The amino acid changes are generally of a minor nature, that is conservative amino acid substitutions or insertions that do not significantly affect the folding and/or activity of the protein; small deletions, typically of one to about 30 amino acids; small amino-terminal or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

Examples of conservative substitutions are within the group of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine and methionine). Amino acid substitutions that do not generally alter specific activity are known in the art and are described, for example, by H. Neurath and R. L. Hill, 1979, In, *The Proteins*, Academic Press, New York. The most commonly occurring exchanges are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, Leu/Val, Ala/Glu, and Asp/Gly.

Alternatively, the amino acid changes are of such a nature that the physico-chemical properties of the polypeptides are altered. For example, amino acid changes may improve the thermal stability of the alpha-amylase, alter the substrate specificity, change the pH optimum, and the like.

Essential amino acids can be identified according to procedures known in the art, such as site-directed mutagenesis or alanine-scanning mutagenesis (Cunningham and Wells, 1989, *Science* 244: 1081-1085). In the latter technique, single alanine mutations are introduced at every residue in the molecule, and the resultant mutant molecules are tested for activity to identify amino acid residues that are critical to the activity of the molecule. See also, Hilton et al., 1996, *J. Biol. Chem.* 271: 4699-4708. The active site or other biological interaction can also be determined by physical analysis of structure, as determined by such techniques as nuclear magnetic resonance, crystallography, electron diffraction, or photoaffinity labeling, in conjunction with mutation of putative contact site amino acids. See, for example, de Vos et al., 1992, *Science* 255: 306-312; Smith et al., 1992, *J. Mol. Biol.* 224: 899-904; Wlodaver et al., 1992, *FEBS Lett.* 309: 59-64. The identities of essential amino acids can also be inferred from analysis of identities with other alpha-amylases that are related to the referenced alpha-amylase.

Additional guidance on the structure-activity relationship of the polypeptides herein can be determined using multiple sequence alignment (MSA) techniques well-known in the art. Based on the teachings herein, the skilled artisan could make similar alignments with any number of alpha-amylases described herein or known in the art. Such alignments aid the skilled artisan to determine potentially relevant domains (e.g., binding domains or catalytic domains), as well as which amino acid residues are conserved and not conserved among the different alpha-amylase sequences. It is appreciated in the art that changing an amino acid that is conserved at a particular position between disclosed polypeptides will more likely result in a change in biological activity (Bowie et al., 1990, *Science* 247: 1306-1310: "Residues that are directly involved in protein functions such as binding or catalysis will certainly be among the most conserved"). In contrast, substituting an amino acid that is not highly conserved among the polypeptides will not likely or significantly alter the biological activity.

Even further guidance on the structure-activity relationship for the skilled artisan can be found in published x-ray crystallography studies known in the art.

Single or multiple amino acid substitutions, deletions, and/or insertions can be made and tested using known methods of mutagenesis, recombination, and/or shuffling, followed by a relevant screening procedure, such as those disclosed by Reidhaar-Olson and Sauer, 1988, *Science* 241: 53-57; Bowie and Sauer, 1989, *Proc. Natl. Acad. Sci. USA* 86: 2152-2156; WO95/17413; or WO95/22625. Other methods that can be used include error-prone PCR, phage display (e.g., Lowman et al., 1991, *Biochemistry* 30: 10832-10837; U.S. Pat. No. 5,223,409; WO92/06204), and region-directed mutagenesis (Derbyshire et al., 1986, *Gene* 46: 145; Ner et al., 1988, *DNA* 7: 127).

Mutagenesis/shuffling methods can be combined with high-throughput, automated screening methods to detect activity of cloned, mutagenized polypeptides expressed by host cells (Ness et al., 1999, *Nature Biotechnology* 17: 893-896). Mutagenized DNA molecules that encode active alpha-amylases can be recovered from the host cells and rapidly sequenced using standard methods in the art. These methods allow the rapid determination of the importance of individual amino acid residues in a polypeptide.

In some embodiments, the alpha-amylase has at least 20%, e.g., at least 40%, at least 50%, at least 60%, at least 70%, at least 80%, at least 90%, at least 95%, at least 96%, at least 97%, at least 98%, at least 99%, or 100% of the alpha-amylase activity of any alpha-amylase described or referenced herein (e.g., any one of SEQ ID NOs: 76-101, 121-174 and 231) under the same conditions.

In one embodiment, the alpha-amylase coding sequence hybridizes under at least low stringency conditions, e.g., medium stringency conditions, medium-high stringency conditions, high stringency conditions, or very high stringency conditions with the full-length complementary strand of the coding sequence from any alpha-amylase described or referenced herein (e.g., any one of SEQ ID NOs: 76-101, 121-174 and 231). In one embodiment, the alpha-amylase coding sequence has at least 65%, e.g., at least 70%, at least 75%, at least 80%, at least 85%, at least 85%, at least 90%, at least 91%, at least 92%, at least 93%, at least 94%, at least 95%, at least 96%, at least 97%, at least 98%, at least 99%, or 100% sequence identity with the coding sequence from any alpha-amylase described or referenced herein (e.g., any one of SEQ ID NOs: 76-101, 121-174 and 231).

In one embodiment, the alpha-amylase comprises the coding sequence of any alpha-amylase described or referenced herein (any one of SEQ ID NOs: 76-101, 121-174 and 231). In one embodiment, the alpha-amylase comprises a coding sequence that is a subsequence of the coding sequence from any alpha-amylase described or referenced herein, wherein the subsequence encodes a polypeptide having alpha-amylase activity. In one embodiment, the number of nucleotides residues in the subsequence is at least 75%, e.g., at least 80%, 85%, 90%, or 95% of the number of the referenced coding sequence.

The referenced coding sequence of any related aspect or embodiment described herein can be the native coding sequence or a degenerate sequence, such as a codon-optimized coding sequence designed for use in a particular host cell (e.g., optimized for expression in *Saccharomyces cerevisiae*).

The alpha-amylase may be a fused polypeptide or cleavable fusion polypeptide in which another polypeptide is fused at the N-terminus or the C-terminus of the alpha-amylase. A fused polypeptide may be produced by fusing a polynucleotide encoding another polypeptide to a polynucleotide encoding the alpha-amylase. Techniques for producing fusion polypeptides are known in the art, and include ligating the coding sequences encoding the polypeptides so that they are in frame and that expression of the fused polypeptide is under control of the same promoter(s) and terminator. Fusion proteins may also be constructed using intein technology in which fusions are created post-translationally (Cooper et al., 1993, *EMBO J.* 12: 2575-2583; Dawson et al., 1994, *Science* 266: 776-779).

Trehalases

The expressed and/or exogenous trehalase can be any trehalase that is suitable for the fermenting organisms and/or their methods of use described herein, such as a naturally occurring trehalase or a variant thereof that retains trehalase activity. Any trehalase contemplated for expression by a fermenting organism described below is also contemplated for aspects of the invention involving exogenous addition of a trehalase (e.g., added before, during or after liquefaction and/or saccharification).

In some embodiments, the fermenting organism comprising a heterologous polynucleotide encoding a trehalase has an increased level of trehalase activity compared to the host cells without the heterologous polynucleotide encoding the trehalase, when cultivated under the same conditions. In some embodiments, the fermenting organism has an increased level of trehalase activity of at least 5%, e.g., at least 10%, at least 15%, at least 20%, at least 25%, at least 50%, at least 100%, at least 150%, at least 200%, at least 300%, or at 500% compared to the fermenting organism without the heterologous polynucleotide encoding the trehalase, when cultivated under the same conditions.

Trehalases that may be expressed with the fermenting organisms and used with the methods described herein include, but are not limited to, trehalases shown in Table 2 (or derivatives thereof).

TABLE 2

| Donor Organism (catalytic domain) | SEQ ID NO: (mature polypeptide) |
|---|---|
| Chaetomium megalocarpum | 175 |
| Lecanicillium psalliotae | 176 |
| Doratomyces sp | 177 |
| Mucor moelleri | 178 |
| Phialophora cyclaminis | 179 |
| Thielavia arenaria | 180 |
| Thielavia antarctica | 181 |
| Chaetomium sp | 182 |
| Chaetomium nigricolor | 183 |
| Chaetomium jodhpurense | 184 |
| Chaetomium piluliferum | 185 |
| Myceliophthora hinnulea | 186 |
| Chloridium virescens | 187 |
| Gelasinospora cratophora | 188 |
| Acidobacteriaceae bacterium | 189 |
| Acidobacterium capsulatum | 190 |
| Acidovorax wautersii | 191 |
| Xanthomonas arboricola | 192 |
| Kosakonia sacchari | 193 |
| Enterobacter sp | 194 |
| Saitozyma flava | 195 |
| Phaeotremella skinneri | 196 |

TABLE 2-continued

| Donor Organism (catalytic domain) | SEQ ID NO: (mature polypeptide) |
|---|---|
| Trichoderma asperellum | 197 |
| Corynascus sepedonium | 198 |
| Myceliophthora thermophila | 199 |
| Trichoderma reesei | 200 |
| Chaetomium virescens | 201 |
| Rhodothermus marinus | 202 |
| Myceliophthora sepedonium | 203 |
| Moelleriella libera | 204 |
| Acremonium dichromosporum | 205 |
| Fusarium sambucinum | 206 |
| Phoma sp | 207 |
| Lentinus similis | 208 |
| Diaporthe nobilis | 209 |
| Solicoccozyma terricola | 210 |
| Dioszegia cryoxerica | 211 |
| Talaromyces funiculosus | 212 |
| Hamigera avellanea | 213 |
| Talaromyces ruber | 214 |
| Trichoderma lixii | 215 |
| Aspergillus cervinus | 216 |
| Rasamsonia brevistipitata | 217 |
| Acremonium curvulum | 218 |
| Talaromyces piceae | 219 |
| Penicillium sp | 220 |
| Talaromyces aurantiacus | 221 |
| Talaromyces pinophilus | 222 |
| Talaromyces leycettanus | 223 |
| Talaromyces variabilis | 224 |
| Aspergillus niger | 225 |
| Trichoderma reesei | 226 |

Additional polynucleotides encoding suitable trehalases may be derived from microorganisms of any suitable genus, including those readily available within the UniProtKB database (www uniprot.org).

The trehalase coding sequences can also be used to design nucleic acid probes to identify and clone DNA encoding trehalases from strains of different genera or species, as described supra.

The polynucleotides encoding trehalases may also be identified and obtained from other sources including microorganisms isolated from nature (e.g., soil, composts, water, etc.) or DNA samples obtained directly from natural materials (e.g., soil, composts, water, etc,) as described supra.

Techniques used to isolate or clone polynucleotides encoding trehalases are described supra.

In one embodiment, the trehalase has a mature polypeptide sequence that comprises or consists of the amino acid sequence of any one of the trehalases described or referenced herein (e.g., any one of SEQ ID NOs: 175-226). In another embodiment, the trehalase has a mature polypeptide sequence that is a fragment of the any one of the trehalases described or referenced herein (e.g., any one of SEQ ID NOs: 175-226). In one embodiment, the number of amino acid residues in the fragment is at least 75%, e.g., at least 80%, 85%, 90%, or 95% of the number of amino acid residues in referenced full length trehalase (e.g. any one of SEQ ID NOs: 175-226). In other embodiments, the trehalase may comprise the catalytic domain of any trehalase described or referenced herein (e.g., the catalytic domain of any one of SEQ ID NOs: 175-226).

The trehalase may be a variant of any one of the trehalases described supra (e.g., any one of SEQ ID NOs: 175-226). In one embodiment, the trehalase has a mature polypeptide sequence of at least 60%, e.g., at least 65%, 70%, 75%, 80%, 85%, 90%, 95%, 97%, 98%, 99%, or 100% sequence identity to any one of the trehalases described supra (e.g., any one of SEQ ID NOs: 175-226).

In one embodiment, the trehalase has a mature polypeptide sequence that differs by no more than ten amino acids, e.g., by no more than five amino acids, by no more than four amino acids, by no more than three amino acids, by no more than two amino acids, or by one amino acid from the amino acid sequence of any one of the trehalases described supra (e.g., any one of SEQ ID NOs: 175-226). In one embodiment, the trehalase has an amino acid substitution, deletion, and/or insertion of one or more (e.g., two, several) of amino acid sequence of any one of the trehalases described supra (e.g., any one of SEQ ID NOs: 175-226). In some embodiments, the total number of amino acid substitutions, deletions and/or insertions is not more than 10, e.g., not more than 9, 8, 7, 6, 5, 4, 3, 2, or 1.

In some embodiments, the trehalase has at least 20%, e.g., at least 40%, at least 50%, at least 60%, at least 70%, at least 80%, at least 90%, at least 95%, at least 96%, at least 97%, at least 98%, at least 99%, or 100% of the trehalase activity of any trehalase described or referenced herein (e.g., any one of SEQ ID NOs: 175-226) under the same conditions.

In one embodiment, the trehalase coding sequence hybridizes under at least low stringency conditions, e.g., medium stringency conditions, medium-high stringency conditions, high stringency conditions, or very high stringency conditions with the full-length complementary strand of the coding sequence from any trehalase described or referenced herein (e.g., any one of SEQ ID NOs: 175-226). In one embodiment, the trehalase coding sequence has at least 65%, e.g., at least 70%, at least 75%, at least 80%, at least 85%, at least 85%, at least 90%, at least 91%, at least 92%, at least 93%, at least 94%, at least 95%, at least 96%, at least 97%, at least 98%, at least 99%, or 100% sequence identity with the coding sequence from any trehalase described or referenced herein (e.g., any one of SEQ ID NOs: 175-226).

In one embodiment, the trehalase comprises the coding sequence of any trehalase described or referenced herein (any one of SEQ ID NOs: 175-226). In one embodiment, the trehalase comprises a coding sequence that is a subsequence of the coding sequence from any trehalase described or referenced herein, wherein the subsequence encodes a polypeptide having trehalase activity. In one embodiment, the number of nucleotides residues in the subsequence is at least 75%, e.g., at least 80%, 85%, 90%, or 95% of the number of the referenced coding sequence.

The referenced coding sequence of any related aspect or embodiment described herein can be the native coding sequence or a degenerate sequence, such as a codon-optimized coding sequence designed for use in a particular host cell (e.g., optimized for expression in Saccharomyces cerevisiae).

The trehalase can also include fused polypeptides or cleavable fusion polypeptides, as described supra.

Glucoamylases

The expressed and/or exogenous glucoamylase can be any glucoamylase that is suitable for the fermenting organisms and/or their methods of use described herein, such as a naturally occurring glucoamylase or a variant thereof that retains glucoamylase activity. Any glucoamylase contemplated for expression by a fermenting organism described below is also contemplated for aspects of the invention involving exogenous addition of a glucoamylase (e.g., added before, during or after liquefaction and/or saccharification).

In some embodiments, the fermenting organism comprises a heterologous polynucleotide encoding a glucoamylase, for example, as described in WO2017/087330, the content of which is hereby incorporated by reference. Any glucoamylase described or referenced herein is contemplated for expression in the fermenting organism.

In some embodiments, the fermenting organism comprising a heterologous polynucleotide encoding an glucoamylase has an increased level of glucoamylase activity compared to the host cells without the heterologous polynucleotide encoding the glucoamylase, when cultivated under the same conditions. In some embodiments, the fermenting organism has an increased level of glucoamylase activity of at least 5%, e.g., at least 10%, at least 15%, at least 20%, at least 25%, at least 50%, at least 100%, at least 150%, at least 200%, at least 300%, or at 500% compared to the fermenting organism without the heterologous polynucleotide encoding the glucoamylase, when cultivated under the same conditions.

Exemplary glucoamylases that can be used with the host cells and/or the methods described herein include bacterial, yeast, or filamentous fungal glucoamylases, e.g., obtained from any of the microorganisms described or referenced herein, as described supra under the sections related to alpha-amylases.

The glucoamylase may be derived from any suitable source, e.g., derived from a microorganism or a plant. Preferred glucoamylases are of fungal or bacterial origin, selected from the group consisting of $Aspergillus$ glucoamylases, in particular $Aspergillus$ $niger$ G1 or G2 glucoamylase (Boel et al. (1984), EMBO J. 3 (5), p. 1097-1102), or variants thereof, such as those disclosed in WO92/00381, WO00/04136 and WO01/04273 (from Novozymes, Denmark); the $A.$ $awamori$ glucoamylase disclosed in WO84/02921, $Aspergillus$ $oryzae$ glucoamylase (Agric. Biol. Chem. (1991), 55 (4), p. 941-949), or variants or fragments thereof. Other $Aspergillus$ glucoamylase variants include variants with enhanced thermal stability: G137A and G139A (Chen et al. (1996), Prot. Eng. 9, 499-505); D257E and D293E/Q (Chen et al. (1995), Prot. Eng. 8, 575-582); N182 (Chen et al. (1994), Biochem. J. 301, 275-281); disulphide bonds, A246C (Fierobe et al. (1996), Biochemistry, 35, 8698-8704; and introduction of Pro residues in position A435 and S436 (Li et al. (1997), $Protein$ $Eng.$ 10, 1199-1204.

Other glucoamylases include $Athelia$ $rolfsii$ (previously denoted $Corticium$ $rolfsii$) glucoamylase (see U.S. Pat. No. 4,727,026 and (Nagasaka et al. (1998) "Purification and properties of the raw-starch-degrading glucoamylases from $Corticium$ $rolfsii$, Appl Microbiol Biotechnol 50:323-330), $Talaromyces$ glucoamylases, in particular derived from $Talaromyces$ $emersonii$ (WO99/28448), $Talaromyces$ $leycettanus$ (U.S. Pat. No. Re. 32,153), $Talaromyces$ $duponti,$ $Talaromyces$ $thermophilus$ (U.S. Pat. No. 4,587,215). In one embodiment, the glucoamylase used during saccharification and/or fermentation is the $Talaromyces$ $emersonii$ glucoamylase disclosed in WO99/28448.

Bacterial glucoamylases contemplated include glucoamylases from the genus $Clostridium$, in particular $C.$ $thermoamylolyticum$ (EP 135,138), and $C.$ $thermohydrosulfuricum$ (WO86/01831).

Contemplated fungal glucoamylases include $Trametes$ $cingulate,$ $Pachykytospora$ $papyracea$; and $Leucopaxillus$ $giganteus$ all disclosed in WO2006/069289; or $Peniophora$ $rufomarginata$ disclosed in WO2007/124285; or a mixture thereof. Also hybrid glucoamylase are contemplated. Examples include the hybrid glucoamylases disclosed in WO2005/045018.

In one embodiment, the glucoamylase is derived from a strain of the genus $Pycnoporus$, in particular a strain of $Pycnoporus$ as described in WO2011/066576 (SEQ ID NO:

2, 4 or 6 therein), including the *Pycnoporus sanguineus* glucoamylase, or from a strain of the genus *Gloeophyllum*, such as a strain of *Gloeophyllum sepiarium* or *Gloeophyllum trabeum*, in particular a strain of *Gloeophyllum* as described in WO2011/068803 (SEQ ID NO: 2, 4, 6, 8, 10, 12, 14 or 16 therein). In one embodiment, the glucoamylase is SEQ ID NO: 2 in WO2011/068803 (i.e. *Gloeophyllum sepiarium* glucoamylase). In one embodiment, the glucoamylase is the *Gloeophyllum sepiarium* glucoamylase of SEQ ID NO: 8. In one embodiment, the glucoamylase is the *Pycnoporus sanguineus* glucoamylase of SEQ ID NO: 229.

In one embodiment, the glucoamylase is a *Gloeophyllum trabeum* glucoamylase (disclosed as SEQ ID NO: 3 in WO2014/177546). In another embodiment, the glucoamylase is derived from a strain of the genus *Nigrofomes*, in particular a strain of *Nigrofomes* sp. disclosed in WO2012/064351 (disclosed as SEQ ID NO: 2 therein).

Also contemplated are glucoamylases with a mature polypeptide sequence which exhibit a high identity to any of the above mentioned glucoamylases, i.e., at least 60%, such as at least 70%, at least 75%, at least 80%, at least 85%, at least 90%, at least 95%, at least 96%, at least 97%, at least 98%, at least 99% or even 100% identity to any one of the mature polypeptide sequences mentioned above.

Glucoamylases may be added to the saccharification and/or fermentation in an amount of 0.0001-20 AGU/g DS, such as 0.001-10 AGU/g DS, 0.01-5 AGU/g DS, or 0.1-2 AGU/g DS.

Glucoamylases may be added to the saccharification and/or fermentation in an amount of 1-1,000 μg EP/g DS, such as 10-500 μg/gDS, or 25-250 μg/g DS.

Glucoamylases may be added to liquefaction in an amount of 0.1-100 μg EP/g DS, such as 0.5-50 μg EP/g DS, 1-25 μg EP/g DS, or 2-12 μg EP/g DS.

In one embodiment, the glucoamylase is added as a blend further comprising an alpha-amylase (e.g., any alpha-amylase described herein). In one embodiment, the alpha-amylase is a fungal alpha-amylase, especially an acid fungal alpha-amylase. The alpha-amylase is typically a side activity.

In one embodiment, the glucoamylase is a blend comprising *Talaromyces emersonii* glucoamylase disclosed in WO99/28448 as SEQ ID NO: 34 and *Trametes cingulata* glucoamylase disclosed as SEQ ID NO: 2 in WO06/069289.

In one embodiment, the glucoamylase is a blend comprising *Talaromyces emersonii* glucoamylase disclosed in WO99/28448, *Trametes cingulata* glucoamylase disclosed as SEQ ID NO: 2 in WO06/69289, and an alpha-amylase.

In one embodiment, the glucoamylase is a blend comprising *Talaromyces emersonii* glucoamylase disclosed in WO99/28448, *Trametes cingulata* glucoamylase disclosed in WO06/69289, and *Rhizomucor pusillus* alpha-amylase with *Aspergillus niger* glucoamylase linker and SBD disclosed as V039 in Table 5 in WO2006/069290.

In one embodiment, the glucoamylase is a blend comprising *Gloeophyllum sepiarium* glucoamylase shown as SEQ ID NO: 2 in WO2011/068803 and an alpha-amylase, in particular *Rhizomucor pusillus* alpha-amylase with an *Aspergillus niger* glucoamylase linker and starch-binding domain (SBD), disclosed SEQ ID NO: 3 in WO2013/006756, in particular with the following substitutions: G128D+D143N.

In one embodiment, the alpha-amylase may be derived from a strain of the genus *Rhizomucor*, preferably a strain the *Rhizomucor pusillus*, such as the one shown in SEQ ID NO: 3 in WO2013/006756, or the genus *Meripilus*, preferably a strain of *Meripilus giganteus*. In one embodiment, the alpha-amylase is derived from a *Rhizomucor pusillus* with an *Aspergillus niger* glucoamylase linker and starch-binding domain (SBD), disclosed as V039 in Table 5 in WO2006/069290.

In one embodiment, the *Rhizomucor pusillus* alpha-amylase or the *Rhizomucor pusillus* alpha-amylase with an *Aspergillus niger* glucoamylase linker and starch-binding domain (SBD) has at least one of the following substitutions or combinations of substitutions: D165M; Y141W; Y141R; K136F; K192R; P224A; P224R; S123H+Y141W; G20S+Y141W; A76G+Y141W; G128D+Y141W; G128D+D143N; P219C+Y141W; N142D+D143N; Y141W+K192R; Y141W+D143N; Y141W+N383R; Y141W+P219C+A265C; Y141W+N142D+D143N; Y141W+K192R V410A; G128D+Y141W+D143N; Y141W+D143N+P219C; Y141W+D143N+K192R; G128D+D143N+K192R; Y141W+D143N+K192R+P219C; and G128D+Y141W+D143N+K192R; or G128D+Y141W+D143N+K192R+P219C (using SEQ ID NO: 3 in WO2013/006756 for numbering).

In one embodiment, the glucoamylase blend comprises *Gloeophyllum sepiarium* glucoamylase (e.g., SEQ ID NO: 2 in WO2011/068803) and *Rhizomucor pusillus* alpha-amylase.

In one embodiment, the glucoamylase blend comprises *Gloeophyllum sepiarium* glucoamylase shown as SEQ ID NO: 2 in WO2011/068803 and *Rhizomucor pusillus* with an *Aspergillus niger* glucoamylase linker and starch-binding domain (SBD), disclosed SEQ ID NO: 3 in WO2013/006756 with the following substitutions: G128D+D143N.

Commercially available compositions comprising glucoamylase include AMG 200L; AMG 300 L; SAN™ SUPER, SAN™ EXTRA L, SPIRIZYME® PLUS, SPIRIZYME® FUEL, SPIRIZYME® B4U, SPIRIZYME® ULTRA, SPIRIZYME® EXCEL, SPIRIZYME ACHIEVE®, and AMG® E (from Novozymes A/S); OPTIDEX™ 300, GC480, GC417 (from DuPont-Danisco); AMIGASE™ and AMIGASE™ PLUS (from DSM); G-ZYME™ G900, G-ZYME™ and G990 ZR (from DuPont-Danisco).

In one embodiment, the glucoamylase is derived from the *Debaryomyces occidentalis* glucoamylase of SEQ ID NO: 102. In one embodiment, the glucoamylase is derived from the *Saccharomycopsis fibuligera* glucoamylase of SEQ ID NO: 103. In one embodiment, the glucoamylase is derived from the *Saccharomycopsis fibuligera* glucoamylase of SEQ ID NO: 104. In one embodiment, the glucoamylase is derived from the *Saccharomyces cerevisiae* glucoamylase of SEQ ID NO: 105. In one embodiment, the glucoamylase is derived from the *Aspergillus niger* glucoamylase of SEQ ID NO: 106. In one embodiment, the glucoamylase is derived from the *Aspergillus oryzae* glucoamylase of SEQ ID NO: 107. In one embodiment, the glucoamylase is derived from the *Rhizopus oryzae* glucoamylase of SEQ ID NO: 108. In one embodiment, the glucoamylase is derived from the *Clostridium thermocellum* glucoamylase of SEQ ID NO: 109. In one embodiment, the glucoamylase is derived from the *Clostridium thermocellum* glucoamylase of SEQ ID NO: 110. In one embodiment, the glucoamylase is derived from the Arxula adeninivorans glucoamylase of SEQ ID NO: 111. In one embodiment, the glucoamylase is derived from the *Hormoconis resinae* glucoamylase of SEQ ID NO: 112. In one embodiment, the glucoamylase is derived from the *Aureobasidium pullulans* glucoamylase of SEQ ID NO: 113.

In one embodiment, the glucoamylase is a *Trichoderma reesei* glucoamylase, such as the *Trichoderma reesei* glucoamylase of SEQ ID NO: 230.

In one embodiment, the glucoamylase has a Relative Activity heat stability at 85° C. of at least 20%, at least 30%, or at least 35% determined as described in Example 4 of WO2018/098381 (heat stability).

In one embodiment, the glucoamylase has a relative activity pH optimum at pH 5.0 of at least 90%, e.g., at least 95%, at least 97%, or 100% determined as described in Example 4 of WO2018/098381 (pH optimum).

In one embodiment, the glucoamylase has a pH stability at pH 5.0 of at least 80%, at least 85%, at least 90% determined as described in Example 4 of WO2018/098381 (pH stability).

In one embodiment, the glucoamylase used in liquefaction, such as a *Penicillium oxalicum* glucoamylase variant, has a thermostability determined as DSC Td at pH 4.0 as described in Example 15 of WO2018/098381 of at least 70° C., preferably at least 75° C., such as at least 80° C., such as at least 81° C., such as at least 82° C., such as at least 83° C., such as at least 84° C., such as at least 85° C., such as at least 86° C., such as at least 87%, such as at least 88° C., such as at least 89° C., such as at least 90° C. In one embodiment, the glucoamylase, such as a *Penicillium oxalicum* glucoamylase variant, has a thermostability determined as DSC Td at pH 4.0 as described in Example 15 of WO2018/098381 in the range between 70° C. and 95° C., such as between 80° C. and 90° C.

In one embodiment, the glucoamylase, such as a *Penicillium oxalicum* glucoamylase variant, used in liquefaction has a thermostability determined as DSC Td at pH 4.8 as described in Example 15 of WO2018/098381 of at least 70° C., preferably at least 75° C., such as at least 80° C., such as at least 81° C., such as at least 82° C., such as at least 83° C., such as at least 84° C., such as at least 85° C., such as at least 86° C., such as at least 87%, such as at least 88° C., such as at least 89° C., such as at least 90° C., such as at least 91° C. In one embodiment, the glucoamylase, such as a *Penicillium oxalicum* glucoamylase variant, has a thermostability determined as DSC Td at pH 4.8 as described in Example 15 of WO2018/098381 in the range between 70° C. and 95° C., such as between 80° C. and 90° C.

In one embodiment, the glucoamylase, such as a *Penicillium oxalicum* glucoamylase variant, used in liquefaction has a residual activity determined as described in Example 16 of WO2018/098381, of at least 100% such as at least 105%, such as at least 110%, such as at least 115%, such as at least 120%, such as at least 125%. In one embodiment, the glucoamylase, such as a *Penicillium oxalicum* glucoamylase variant, has a thermostability determined as residual activity as described in Example 16 of WO2018/098381, in the range between 100% and 130%.

In one embodiment, the glucoamylase, e.g., of fungal origin such as a filamentous fungi, from a strain of the genus *Penicillium*, e.g., a strain of *Penicillium oxalicum*, in particular the *Penicillium oxalicum* glucoamylase disclosed as SEQ ID NO: 2 in WO2011/127802 (which is hereby incorporated by reference).

In one embodiment, the glucoamylase has a mature polypeptide sequence of at least 80%, e.g., at least 85%, at least 90%, at least 91%, at least 92%, at least 93%, at least 94%, at least 95%, at least 96%, at least 97%, at least 98%, at least 99% or 100% identity to the mature polypeptide shown in SEQ ID NO: 2 in WO2011/127802.

In one embodiment, the glucoamylase is a variant of the *Penicillium oxalicum* glucoamylase disclosed as SEQ ID NO: 2 in WO2011/127802, having a K79V substitution. The K79V glucoamylase variant has reduced sensitivity to protease degradation relative to the parent as disclosed in WO2013/036526 (which is hereby incorporated by reference).

In one embodiment, the glucoamylase is derived from *Penicillium oxalicum*.

In one embodiment, the glucoamylase is a variant of the *Penicillium oxalicum* glucoamylase disclosed as SEQ ID NO: 2 in WO2011/127802. In one embodiment, the *Penicillium oxalicum* glucoamylase is the one disclosed as SEQ ID NO: 2 in WO2011/127802 having Val (V) in position 79.

Contemplated *Penicillium oxalicum* glucoamylase variants are disclosed in WO2013/053801 which is hereby incorporated by reference.

In one embodiment, these variants have reduced sensitivity to protease degradation.

In one embodiment, these variant have improved thermostability compared to the parent.

In one embodiment, the glucoamylase has a K79V substitution (using SEQ ID NO: 2 of WO2011/127802 for numbering), corresponding to the PE001 variant, and further comprises one of the following alterations or combinations of alterations T65A; Q327F; E501V; Y504T; Y504*; T65A+Q327F; T65A+E501V; T65A+Y504T; T65A+Y504*; Q327F+E501V; Q327F+Y504T; Q327F+Y504*; E501V+Y504T; E501V+Y504*; T65A+Q327F+E501V; T65A+Q327F+Y504T; T65A+E501V+Y504T; Q327F+E501V+Y504T; T65A+Q327F+Y504*; T65A+E501V+Y504*; Q327F+E501V+Y504*; T65A+Q327F+E501V+Y504T; T65A+Q327F+E501V+Y504*; E501V+Y504T; T65A+K161S; T65A+Q405T; T65A+Q327W; T65A+Q327F; T65A+Q327Y; P11F+T65A+Q327F; R1K+D3W+K5Q+G7V+N8S+T10K+P11S+T65A+Q327F; P2N+P4S+P11F+T65A+Q327F; P11F+D26C+K33C+T65A+Q327F; P2N+P4S+P11F+T65A+Q327W+E501V+Y504T; R1E+D3N+P4G+G6R+G7A+N8A+T10D+P11D+T65A+Q327F; P11F+T65A+Q327W; P2N+P4S+P11F+T65A+Q327F+E501V+Y504T; P11F+T65A+Q327W+E501V+Y504T; T65A+Q327F+E501V+Y504T; T65A+S105P+Q327W; T65A+S105P+Q327F; T65A+Q327W+S364P; T65A+Q327F+S364P; T65A+S103N+Q327F; P2N+P4S+P11F+K34Y+T65A+Q327F; P2N+P4S+P11F+T65A+Q327F+D445N+V447S; P2N+P4S+P11F+T65A+I172V+Q327F; P2N+P4S+P11F+T65A+Q327F+N502*; P2N+P4S+P11F+T65A+Q327F+N502T+P563S+K571E; P2N+P4S+P11F+R31S+K33V+T65A+Q327F+N564D+K571S; P2N+P4S+P11F+T65A+Q327F+S377T; P2N+P4S+P11F+T65A+V325T+Q327W; P2N+P4S+P11F+T65A+Q327F+D445N+V447S+E501V+Y504T; P2N+P4S+P11F+T65A+I172V+Q327F+E501V+Y504T; P2N+P4S+P11F+T65A+Q327F+S377T+E501V+Y504T; P2N+P4S+P11F+D26N+K34Y+T65A+Q327F; P2N+P4S+P11F+T65A+Q327F+I375A+E501V+Y504T; P2N+P4S+P11F+T65A+K218A+K221D+Q327F+E501V+Y504T; P2N+P4S+P11F+T65A+S103N+Q327F+E501V+Y504T; P2N+P4S+T10D+T65A+Q327F+E501V+Y504T; P2N+P4S+F12Y+T65A+Q327F+E501V+Y504T; K5A+P11F+T65A+Q327F+E501V+Y504T; P2N+P4S+T10E+E18N+T65A+Q327F+E501V+Y504T; P2N+P4S+T10E+E18N+T65A+Q327F+E501V+Y504T; P2N+P4S+P11F+T65A+Q327F+E501V+Y504T+T568N; P2N+P4S+P11F+T65A+Q327F+E501V+Y504T+K524T+G526A; P2N+P4S+P11F+K34Y+T65A+Q327F+D445N+V447S+

E501V+Y504T; P2N+P4S+P11F+R31S+K33V+T65A+Q327F+D445N+V447S+E501V+Y504T; P2N+P4S+P11F+D26N+K34Y+T65A+Q327F+E501V+Y504T; P2N+P4S+P11F+T65A+F80*+Q327F+E501V+Y504T; P2N+P4S+P11F+T65A+K112S+Q327F+E501V+Y504T; P2N+P4S+P11F+T65A+Q327F+E501V+Y504T+T516P+K524T+G526A; P2N+P4S+P11F+T65A+Q327F+E501V+N502T+Y504*; P2N+P4S+P11F+T65A+Q327F+E501V+Y504T; P2N+P4S+P11F+T65A+S103N+Q327F+E501V+Y504T; K5A+P11F+T65A+Q327F+E501V+Y504T; P2N+P4S+P11F+T65A+Q327F+E501V+Y504T+T516P+K524T+G526A; P2N+P4S+P11F+T65A+V79A+Q327F+E501V+Y504T; P2N+P4S+P11F+T65A+V79G+Q327F+E501V+Y504T; P2N+P4S+P11F+T65A+V79I+Q327F+E501V+Y504T; P2N+P4S+P11F+T65A+V79L+Q327F+E501V+Y504T; P2N+P4S+P11F+T65A+V79S+Q327F+E501V+Y504T; P2N+P4S+P11F+T65A+L72V+Q327F+E501V+Y504T; S255N+Q327F+E501V+Y504T; P2N+P4S+P11F+T65A+E74N+V79K+Q327F+E501V+Y504T; P2N+P4S+P11F+T65A+G220N+Q327F+E501V+Y504T; P2N+P4S+P11F+T65A+Y245N+Q327F+E501V+Y504T; P2N+P4S+P11F+T65A+Q253N+Q327F+E501V+Y504T; P2N+P4S+P11F+T65A+D279N+Q327F+E501V+Y504T; P2N+P4S+P11F+T65A+Q327F+S359N+E501V+Y504T; P2N+P4S+P11F+T65A+Q327F+D370N+E501V+Y504T; P2N+P4S+P11F+T65A+Q327F+V460S+E501V+Y504T; P2N+P4S+P11F+T65A+Q327F+V460T+P468T+E501V+Y504T; P2N+P4S+P11F+T65A+Q327F+T463N+E501V+Y504T; P2N+P4S+P11F+T65A+Q327F+S465N+E501V+Y504T; and P2N+P4S+P11F+T65A+Q327F+T477N+E501V+Y504T.

In one embodiment, the *Penicillium oxalicum* glucoamylase variant has a K79V substitution (using SEQ ID NO: 2 of WO2011/127802 for numbering), corresponding to the PE001 variant, and further comprises one of the following substitutions or combinations of substitutions:

P11F+T65A+Q327F;
P2N+P4S+P11F+T65A+Q327F;
P11F+D26C+K33C+T65A+Q327F;
P2N+P4S+P11F+T65A+Q327W+E501V+Y504T;
P2N+P4S+P11F+T65A+Q327F+E501V+Y504T; and
P11F+T65A+Q327W+E501V+Y504T.

Additional glucoamylases contemplated for use with the present invention can be found in WO2011/153516 (the content of which is incorporated herein).

Additional polynucleotides encoding suitable glucoamylases may be obtained from microorganisms of any genus, including those readily available within the UniProtKB database (www.uniprot.org).

The glucoamylase coding sequences can also be used to design nucleic acid probes to identify and clone DNA encoding glucoamylases from strains of different genera or species, as described supra.

The polynucleotides encoding glucoamylases may also be identified and obtained from other sources including microorganisms isolated from nature (e.g., soil, composts, water, etc.) or DNA samples obtained directly from natural materials (e.g., soil, composts, water, etc,) as described supra.

Techniques used to isolate or clone polynucleotides encoding glucoamylases are described supra.

In one embodiment, the glucoamylase has a mature polypeptide sequence that comprises or consists of the amino acid sequence of any one of the glucoamylases described or referenced herein (e.g., any one of SEQ ID NOs: 8, 102-113, 229 and 230). In another embodiment, the glucoamylase has a mature polypeptide sequence that is a fragment of the any one of the glucoamylases described or referenced herein (e.g., any one of SEQ ID NOs: 8, 102-113, 229 and 230). In one embodiment, the number of amino acid residues in the fragment is at least 75%, e.g., at least 80%, 85%, 90%, or 95% of the number of amino acid residues in referenced full length glucoamylase (e.g. any one of SEQ ID NOs: 8, 102-113, 229 and 230). In other embodiments, the glucoamylase may comprise the catalytic domain of any glucoamylase described or referenced herein (e.g., the catalytic domain of any one of SEQ ID NOs: 8, 102-113, 229 and 230).

The glucoamylase may be a variant of any one of the glucoamylases described supra (e.g., any one of SEQ ID NOs: 8, 102-113, 229 and 230). In one embodiment, the glucoamylase has a mature polypeptide sequence of at least 60%, e.g., at least 65%, 70%, 75%, 80%, 85%, 90%, 95%, 97%, 98%, 99%, or 100% sequence identity to any one of the glucoamylases described supra (e.g., any one of SEQ ID NOs: 8, 102-113, 229 and 230).

In one embodiment, the glucoamylase has a mature polypeptide sequence that differs by no more than ten amino acids, e.g., by no more than five amino acids, by no more than four amino acids, by no more than three amino acids, by no more than two amino acids, or by one amino acid from the amino acid sequence of any one of the glucoamylases described supra (e.g., any one of SEQ ID NOs: 8, 102-113, 229 and 230). In one embodiment, the glucoamylase has an amino acid substitution, deletion, and/or insertion of one or more (e.g., two, several) of amino acid sequence of any one of the glucoamylases described supra (e.g., any one of SEQ ID NOs: 8, 102-113, 229 and 230). In some embodiments, the total number of amino acid substitutions, deletions and/or insertions is not more than 10, e.g., not more than 9, 8, 7, 6, 5, 4, 3, 2, or 1.

In some embodiments, the glucoamylase has at least 20%, e.g., at least 40%, at least 50%, at least 60%, at least 70%, at least 80%, at least 90%, at least 95%, at least 96%, at least 97%, at least 98%, at least 99%, or 100% of the glucoamylase activity of any glucoamylase described or referenced herein (e.g., any one of SEQ ID NOs: 8, 102-113, 229 and 230) under the same conditions.

In one embodiment, the glucoamylase coding sequence hybridizes under at least low stringency conditions, e.g., medium stringency conditions, medium-high stringency conditions, high stringency conditions, or very high stringency conditions with the full-length complementary strand of the coding sequence from any glucoamylase described or referenced herein (e.g., any one of SEQ ID NOs: 8, 102-113, 229 and 230). In one embodiment, the glucoamylase coding sequence has at least 65%, e.g., at least 70%, at least 75%, at least 80%, at least 85%, at least 85%, at least 90%, at least 91%, at least 92%, at least 93%, at least 94%, at least 95%, at least 96%, at least 97%, at least 98%, at least 99%, or 100% sequence identity with the coding sequence from any glucoamylase described or referenced herein (e.g., any one of SEQ ID NOs: 8, 102-113, 229 and 230).

In one embodiment, the glucoamylase comprises the coding sequence of any glucoamylase described or referenced herein (any one of SEQ ID NOs: 8, 102-113, 229 and 230). In one embodiment, the glucoamylase comprises a coding sequence that is a subsequence of the coding sequence from any glucoamylase described or referenced herein, wherein the subsequence encodes a polypeptide having glucoamylase activity. In one embodiment, the number of nucleotides residues in the subsequence is at least 75%, e.g., at least 80%, 85%, 90%, or 95% of the number of the referenced coding sequence. The referenced coding sequence of any related aspect or embodiment described herein can be the native coding sequence or a degenerate sequence, such as a codon-optimized coding sequence designed for use in a particular host cell (e.g., optimized for expression in Saccharomyces cerevisiae).

The glucoamylase can also include fused polypeptides or cleavable fusion polypeptides, as described supra.

Proteases

The expressed and/or exogenous protease can be any protease that is suitable for the fermenting organisms and/or their methods of use described herein, such as a naturally occurring protease or a variant thereof that retains protease activity. Any protease contemplated for expression by a fermenting organism described below is also contemplated for aspects of the invention involving exogenous addition of a protease.

Proteases are classified on the basis of their catalytic mechanism into the following groups: Serine proteases (S), Cysteine proteases (C), Aspartic proteases (A), Metallo proteases (M), and Unknown, or as yet unclassified, proteases (U), see Handbook of Proteolytic Enzymes, A. J. Barrett, N. D. Rawlings, J. F. Woessner (eds), Academic Press (1998), in particular the general introduction part.

Protease activity can be measured using any suitable assay, in which a substrate is employed, that includes peptide bonds relevant for the specificity of the protease in question. Assay-pH and assay-temperature are likewise to be adapted to the protease in question. Examples of assay-pH-values are pH 6, 7, 8, 9, 10, or 11. Examples of assay-temperatures are 30, 35, 37, 40, 45, 50, 55, 60, 65, 70 or 80° C.

In some aspects, the fermenting organism comprising a heterologous polynucleotide encoding a protease has an increased level of protease activity compared to the fermenting organism without the heterologous polynucleotide encoding the protease, when cultivated under the same conditions. In some aspects, the fermenting organism has an increased level of protease activity of at least 5%, e.g., at least 10%, at least 15%, at least 20%, at least 25%, at least 50%, at least 100%, at least 150%, at least 200%, at least 300%, or at 500% compared to the fermenting organism without the heterologous polynucleotide encoding the protease, when cultivated under the same conditions.

Exemplary proteases that may be expressed with the fermenting organisms and used with the methods described herein include, but are not limited to, proteases shown in Table 3 (or derivatives thereof).

TABLE 3

| Donor Organism (catalytic domain) | SEQ ID NO: (mature polypeptide) | Family |
|---|---|---|
| Aspergillus niger | 9 | A1 |
| Trichoderma reesei | 10 | |
| Thermoascus aurantiacus | 11 | M35 |
| Dichomitus squalens | 12 | S53 |
| Nocardiopsis prasina | 13 | S1 |
| Penicillium simplicissimum | 14 | S10 |
| Aspergillus niger | 15 | |
| Meriphilus giganteus | 16 | S53 |
| Lecanicillium sp. WMM742 | 17 | S53 |
| Talaromyces proteolyticus | 18 | S53 |

TABLE 3-continued

| Donor Organism (catalytic domain) | SEQ ID NO: (mature polypeptide) | Family |
|---|---|---|
| Penicillium ranomafanaense | 19 | A1A |
| Aspergillus oryzae | 20 | S53 |
| Talaromyces liani | 21 | S10 |
| Thermoascus thermophilus | 22 | S53 |
| Pyrococcus furiosus | 23 | |
| Trichoderma reesei | 24 | |
| Rhizomucor miehei | 25 | |
| Lenzites betulinus | 26 | S53 |
| Neolentinus lepideus | 27 | S53 |
| Thermococcus sp. | 28 | S8 |
| Thermococcus sp. | 29 | S8 |
| Thermomyces lanuginosus | 30 | S53 |
| Thermococcus thioreducens | 31 | S53 |
| Polyporus arcularius | 32 | S53 |
| Ganoderma lucidum | 33 | S53 |
| Ganoderma lucidum | 34 | S53 |
| Ganoderma lucidum | 35 | S53 |
| Trametes sp. AH28-2 | 36 | S53 |
| Cinereomyces lindbladii | 37 | S53 |
| Trametes versicolor O82DDP | 38 | S53 |
| Paecilomyces hepiali | 39 | S53 |
| Isaria tenuipes | 40 | S53 |
| Aspergillus tamarii | 41 | S53 |
| Aspergillus brasiliensis | 42 | S53 |
| Aspergillus iizukae | 43 | S53 |
| Penicillium sp-72364 | 44 | S10 |
| Aspergillus denticulatus | 45 | S10 |
| Hamigera sp. t184-6 | 46 | S10 |
| Penicillium janthinellum | 47 | S10 |
| Penicillium vasconiae | 48 | S10 |
| Hamigera paravellanea | 49 | S10 |
| Talaromyces variabilis | 50 | S10 |
| Penicillium arenicola | 51 | S10 |
| Nocardiopsis kunsanensis | 52 | S1 |
| Streptomyces parvulus | 53 | S1 |
| Saccharopolyspora endophytica | 54 | S' |
| luteus cellwall enrichments K | 55 | S1 |
| Saccharothrix australiensis | 56 | S1 |
| Nocardiopsis baichengensis | 57 | S1 |
| Streptomyces sp. SM15 | 58 | S1 |
| Actinoalloteichus spitiensis | 59 | S1 |
| Byssochlamys verrucosa | 60 | M35 |
| Hamigera terricola | 61 | M35 |
| Aspergillus tamarii | 62 | M35 |
| Aspergillus niveus | 63 | M35 |
| Penicillium sclerotiorum | 64 | A1 |
| Penicillium bilaiae | 65 | A1 |
| Penicillium antarcticum | 66 | A1 |
| Penicillium sumatrense | 67 | A1 |
| Trichoderma lixii | 68 | A1 |
| Trichoderma brevicompactum | 69 | A1 |
| Penicillium cinnamopurpureum | 70 | A1 |
| Bacillus licheniformis | 71 | S8 |
| Bacillus subtilis | 72 | S8 |
| Trametes cf versicol | 73 | S53 |

Additional polynucleotides encoding suitable proteases may be derived from microorganisms of any suitable genus, including those readily available within the UniProtKB database (www.uniprot.org).

In one embodiment, the protease is derived from Aspergillus, such as the Aspergillus niger protease of SEQ ID NO:

9, the *Aspergillus tamarii* protease of SEQ ID NO: 41, or the *Aspergillus denticulatus* protease of SEQ ID NO: 45. In one embodiment, the protease is derived from *Dichomitus*, such as the *Dichomitus squalens* protease of SEQ ID NO: 12. In one embodiment, the protease is derived from *Penicillium*, such as the *Penicillium simplicissimum* protease of SEQ ID NO: 14, the *Penicillium antarcticum* protease of SEQ ID NO: 66, or the *Penicillium sumatrense* protease of SEQ ID NO: 67. In one aspect, the protease is derived from *Meriphilus*, such as the *Meriphilus giganteus* protease of SEQ ID NO: 16. In one aspect, the protease is derived from *Talaromyces*, such as the *Talaromyces liani* protease of SEQ ID NO: 21. In one aspect, the protease is derived from *Thermoascus*, such as the *Thermoascus thermophilus* protease of SEQ ID NO: 22. In one aspect, the protease is derived from *Ganoderma*, such as the *Ganoderma lucidum* protease of SEQ ID NO: 33. In one aspect, the protease is derived from *Hamigera*, such as the *Hamigera terricola* protease of SEQ ID NO: 61. In one aspect, the protease is derived from *Trichoderma*, such as the *Trichoderma brevicompactum* protease of SEQ ID NO: 69.

The protease coding sequences can also be used to design nucleic acid probes to identify and clone DNA encoding proteases from strains of different genera or species, as described supra.

The polynucleotides encoding proteases may also be identified and obtained from other sources including microorganisms isolated from nature (e.g., soil, composts, water, etc.) or DNA samples obtained directly from natural materials (e.g., soil, composts, water, etc,) as described supra.

Techniques used to isolate or clone polynucleotides encoding proteases are described supra.

In one embodiment, the protease has a mature polypeptide sequence that comprises or consists of the amino acid sequence of any one of SEQ ID NOs: 9-73 (e.g., any one of SEQ ID NOs: 9, 14, 16, 21, 22, 33, 41, 45, 61, 62, 66, 67, and 69; such as any one of SEQ NOs: 9, 14, 16, and 69). In another embodiment, the protease has a mature polypeptide sequence that is a fragment of the protease of any one of SEQ ID NOs: 9-73 (e.g., wherein the fragment has protease activity). In one embodiment, the number of amino acid residues in the fragment is at least 75%, e.g., at least 80%, 85%, 90%, or 95% of the number of amino acid residues in referenced full length protease (e.g. any one of SEQ ID NOs: 9-73). In other embodiments, the protease may comprise the catalytic domain of any protease described or referenced herein (e.g., the catalytic domain of any one of SEQ ID NOs: 9-73).

The protease may be a variant of any one of the proteases described supra (e.g., any one of SEQ ID NOs: 9-73. In one embodiment, the protease has a mature polypeptide sequence of at least 60%, e.g., at least 65%, 70%, 75%, 80%, 85%, 90%, 95%, 97%, 98%, 99%, or 100% sequence identity to any one of the proteases described supra (e.g., any one of SEQ ID NOs: 9-73).

In one embodiment, the protease has a mature polypeptide sequence that differs by no more than ten amino acids, e.g., by no more than five amino acids, by no more than four amino acids, by no more than three amino acids, by no more than two amino acids, or by one amino acid from the amino acid sequence of any one of the proteases described supra (e.g., any one of SEQ ID NOs: 9-73). In one embodiment, the protease has an amino acid substitution, deletion, and/or insertion of one or more (e.g., two, several) of amino acid sequence of any one of the proteases described supra (e.g., any one of SEQ ID NOs: 9-73).

In some embodiments, the total number of amino acid substitutions, deletions and/or insertions is not more than 10, e.g., not more than 9, 8, 7, 6, 5, 4, 3, 2, or 1.

In one embodiment, the protease coding sequence hybridizes under at least low stringency conditions, e.g., medium stringency conditions, medium-high stringency conditions, high stringency conditions, or very high stringency conditions with the full-length complementary strand of the coding sequence from any protease described or referenced herein (e.g., any one of SEQ ID NOs: 9-73). In one embodiment, the protease coding sequence has at least 65%, e.g., at least 70%, at least 75%, at least 80%, at least 85%, at least 85%, at least 90%, at least 91%, at least 92%, at least 93%, at least 94%, at least 95%, at least 96%, at least 97%, at least 98%, at least 99%, or 100% sequence identity with the coding sequence from any protease described or referenced herein (e.g., any one of SEQ ID NOs: 9-73).

In one embodiment, the protease comprises the coding sequence of any protease described or referenced herein (any one of SEQ ID NOs: 9-73). In one embodiment, the protease comprises a coding sequence that is a subsequence of the coding sequence from any protease described or referenced herein, wherein the subsequence encodes a polypeptide having protease activity. In one embodiment, the number of nucleotides residues in the subsequence is at least 75%, e.g., at least 80%, 85%, 90%, or 95% of the number of the referenced coding sequence.

The referenced coding sequence of any related aspect or embodiment described herein can be the native coding sequence or a degenerate sequence, such as a codon-optimized coding sequence designed for use in a particular host cell (e.g., optimized for expression in *Saccharomyces cerevisiae*).

The protease can also include fused polypeptides or cleavable fusion polypeptides, as described supra.

In one embodiment, the protease used according to a process described herein is a Serine proteases. In one particular embodiment, the protease is a serine protease belonging to the family 53, e.g., an endo-protease, such as S53 protease from *Meripilus giganteus, Dichomitus squalens Trametes versicolor*, Polyporus arcularius, Lenzites betulinus, *Ganoderma lucidum, Neolentinus lepideus,* or *Bacillus* sp. 19138, in a process for producing ethanol from a starch-containing material, the ethanol yield was improved, when the S53 protease was present/or added during saccharification and/or fermentation of either gelatinized or un-gelatinized starch. In one embodiment, the proteases is selected from: (a) proteases belonging to the EC 3.4.21 enzyme group; and/or (b) proteases belonging to the EC 3.4.14 enzyme group; and/or (c) Serine proteases of the peptidase family S53 that comprises two different types of peptidases: tripeptidyl aminopeptidases (exo-type) and endopeptidases; as described in 1993, *Biochem. J.* 290:205-218 and in MEROPS protease database, release, 9.4 (31 Jan. 2011) (www.merops.ac.uk). The database is described in Rawlings, N. D., Barrett, A. J. and Bateman, A., 2010, "MEROPS: the peptidase database", *Nucl. Acids Res.* 38: D227-D233.

For determining whether a given protease is a Serine protease, and a family S53 protease, reference is made to the above Handbook and the principles indicated therein. Such determination can be carried out for all types of proteases, be it naturally occurring or wild-type proteases; or genetically engineered or synthetic proteases.

Peptidase family S53 contains acid-acting endopeptidases and tripeptidyl-peptidases. The residues of the catalytic triad are Glu, Asp, Ser, and there is an additional acidic residue, Asp, in the oxyanion hole. The order of the residues is Glu, Asp, Asp, Ser. The Ser residue is the nucleophile equivalent to Ser in the Asp, His, Ser triad of subtilisin, and the Glu of the triad is a substitute for the general base, His, in subtilisin.

The peptidases of the S53 family tend to be most active at acidic pH (unlike the homologous subtilisins), and this can be attributed to the functional importance of carboxylic residues, notably Asp in the oxyanion hole. The amino acid sequences are not closely similar to those in family S8 (i.e. serine endopeptidase subtilisins and homologues), and this, taken together with the quite different active site residues and the resulting lower pH for maximal activity, provides for a substantial difference to that family. Protein folding of the peptidase unit for members of this family resembles that of subtilisin, having the clan type SB.

In one embodiment, the protease used according to a process described herein is a Cysteine proteases.

In one embodiment, the protease used according to a process described herein is a Aspartic proteases. Aspartic acid proteases are described in, for example, Hand-book of Proteolytic En-zymes, Edited by A. J. Barrett, N. D. Rawlings and J. F. Woessner, Aca-demic Press, San Diego, 1998, Chapter 270). Suitable examples of aspartic acid protease include, e.g., those disclosed in R. M. Berka et al. Gene, 96, 313 (1990)); (R. M. Berka et al. Gene, 125, 195-198 (1993)); and Gomi et al. Biosci. Biotech. Biochem. 57, 1095-1100 (1993), which are hereby incorporated by reference.

The protease also may be a metalloprotease, which is defined as a protease selected from the group consisting of:
(a) proteases belonging to EC 3.4.24 (metalloendopeptidases); preferably EC 3.4.24.39 (acid metallo proteinases);
(b) metalloproteases belonging to the M group of the above Handbook;
(c) metalloproteases not yet assigned to clans (designation: Clan MX), or belonging to either one of clans MA, MB, MC, MD, ME, MF, MG, MH (as defined at pp. 989-991 of the above Handbook);
(d) other families of metalloproteases (as defined at pp. 1448-1452 of the above Handbook);
(e) metalloproteases with a HEXXH motif;
(f) metalloproteases with an HEFTH motif;
(g) metalloproteases belonging to either one of families M3, M26, M27, M32, M34, M35, M36, M41, M43, or M47 (as defined at pp. 1448-1452 of the above Handbook);
(h) metalloproteases belonging to the M28E family; and
(i) metalloproteases belonging to family M35 (as defined at pp. 1492-1495 of the above Handbook).

In other particular embodiments, metalloproteases are hydrolases in which the nucleophilic attack on a peptide bond is mediated by a water molecule, which is activated by a divalent metal cation. Examples of divalent cations are zinc, cobalt or manganese. The metal ion may be held in place by amino acid ligands. The number of ligands may be five, four, three, two, one or zero. In a particular embodiment the number is two or three, preferably three.

There are no limitations on the origin of the metalloprotease used in a process of the invention. In an embodiment the metalloprotease is classified as EC 3.4.24, preferably EC 3.4.24.39. In one embodiment, the metalloprotease is an acid-stable metalloprotease, e.g., a fungal acid-stable metalloprotease, such as a metalloprotease derived from a strain of the genus *Thermoascus*, preferably a strain of *Thermoascus aurantiacus*, especially *Thermoascus aurantiacus* CGMCC No. 0670 (classified as EC 3.4.24.39). In another embodiment, the metalloprotease is derived from a strain of the genus *Aspergillus*, preferably a strain of *Aspergillus oryzae*.

In one embodiment the metalloprotease has a degree of sequence identity to amino acids −178 to 177, −159 to 177, or preferably amino acids 1 to 177 (the mature polypeptide) of SEQ ID NO: 1 of WO2010/008841 (a *Thermoascus aurantiacus* metalloprotease) of at least 80%, at least 82%, at least 85%, at least 90%, at least 95%, or at least 97%; and which have metalloprotease activity. In particular embodiments, the metalloprotease consists of an amino acid sequence with a degree of identity to SEQ ID NO: 1 as mentioned above.

The *Thermoascus aurantiacus* metalloprotease is a preferred example of a metalloprotease suitable for use in a process of the invention. Another metalloprotease is derived from *Aspergillus oryzae* and comprises the sequence of SEQ ID NO: 11 disclosed in WO2003/048353, or amino acids −23-353; −23-374; −23-397; 1-353; 1-374; 1-397; 177-353; 177-374; or 177-397 thereof, and SEQ ID NO: 10 disclosed in WO2003/048353.

Another metalloprotease suitable for use in a process of the invention is the *Aspergillus oryzae* metalloprotease comprising SEQ ID NO: 5 of WO2010/008841, or a metalloprotease is an isolated polypeptide which has a degree of identity to SEQ ID NO: 5 of at least about 80%, at least 82%, at least 85%, at least 90%, at least 95%, or at least 97%; and which have metalloprotease activity. In particular embodiments, the metalloprotease consists of the amino acid sequence of SEQ ID NO: 5 of WO2010/008841.

In a particular embodiment, a metalloprotease has an amino acid sequence that differs by forty, thirty-five, thirty, twenty-five, twenty, or by fifteen amino acids from amino acids −178 to 177, −159 to 177, or +1 to 177 of the amino acid sequences of the *Thermoascus aurantiacus* or *Aspergillus oryzae* metalloprotease.

In another embodiment, a metalloprotease has an amino acid sequence that differs by ten, or by nine, or by eight, or by seven, or by six, or by five amino acids from amino acids −178 to 177, −159 to 177, or +1 to 177 of the amino acid sequences of these metalloproteases, e.g., by four, by three, by two, or by one amino acid.

In particular embodiments, the metalloprotease a) comprises or b) consists of
i) the amino acid sequence of amino acids −178 to 177, −159 to 177, or +1 to 177 of SEQ ID NO:1 of WO2010/008841;
ii) the amino acid sequence of amino acids −23-353, −23-374, −23-397, 1-353, 1-374, 1-397, 177-353, 177-374, or 177-397 of SEQ ID NO: 3 of WO2010/008841;
iii) the amino acid sequence of SEQ ID NO: 5 of WO2010/008841; or allelic variants, or fragments, of the sequences of i), ii), and iii) that have protease activity.

A fragment of amino acids −178 to 177, −159 to 177, or +1 to 177 of SEQ ID NO: 1 of WO2010/008841 or of amino acids −23-353, −23-374, −23-397, 1-353, 1-374, 1-397, 177-353, 177-374, or 177-397 of SEQ ID NO: 3 of WO2010/008841; is a polypeptide having one or more amino acids deleted from the amino and/or carboxyl terminus of these amino acid sequences. In one embodiment a fragment contains at least 75 amino acid residues, or at least 100 amino acid residues, or at least 125 amino acid residues, or at least 150 amino acid residues, or at least 160 amino acid residues, or at least 165 amino acid residues, or at least 170 amino acid residues, or at least 175 amino acid residues.

To determine whether a given protease is a metallo protease or not, reference is made to the above "Handbook of Proteolytic Enzymes" and the principles indicated therein. Such determination can be carried out for all types of proteases, be it naturally occurring or wild-type proteases; or genetically engineered or synthetic proteases.

The protease may be a variant of, e.g., a wild-type protease, having thermostability properties defined herein. In one embodiment, the thermostable protease is a variant of a metallo protease. In one embodiment, the thermostable protease used in a process described herein is of fungal origin, such as a fungal metallo protease, such as a fungal metallo protease derived from a strain of the genus *Thermoascus*, preferably a strain of *Thermoascus aurantiacus*, especially *Thermoascus aurantiacus* CGMCC No. 0670 (classified as EC 3.4.24.39).

In one embodiment, the thermostable protease is a variant of the mature part of the metallo protease shown in SEQ ID NO: 2 disclosed in WO2003/048353 or the mature part of SEQ ID NO: 1 in WO2010/008841 further with one of the following substitutions or combinations of substitutions:

S5*+D79L+S87P+A112P+D142L;
D79L+S87P+A112P+T124V+D142L;
S5*+N26R+D79L+S87P+A112P+D142L;
N26R+T46R+D79L+S87P+A112P+D142L;
T46R+D79L+S87P+T116V+D142L;
D79L+P81R+S87P+A112P+D142L;
A27K+D79L+S87P+A112P+T124V+D142L;
D79L+Y82F+S87P+A112P+T124V+D142L;
D79L+Y82F+S87P+A112P+T124V+D142L;
D79L+S87P+A112P+T124V+A126V+D142L;
D79L+S87P+A112P+D142L;
D79L+Y82F+S87P+A112P+D142L;
S38T+D79L+S87P+A112P+A126V+D142L;
D79L+Y82F+S87P+A112P+A126V+D142L;
A27K+D79L+S87P+A112P+A126V+D142L;
D79L+S87P+N98C+A112P+G135C+D142L;
D79L+S87P+A112P+D142L+T141C+M161C;
S36P+D79L+S87P+A112P+D142L;
A37P+D79L+S87P+A112P+D142L;
S49P+D79L+S87P+A112P+D142L;
S50P+D79L+S87P+A112P+D142L;
D79L+S87P+D104P+A112P+D142L;
D79L+Y82F+S87G+A112P+D142L;
S70V+D79L+Y82F+S87G+Y97W+A112P+D142L;
D79L+Y82F+S87G+Y97W+D104P+A112P+D142L;
S70V+D79L+Y82F+S87G+A112P+D142L;
D79L+Y82F+S87G+D104P+A112P+D142L;
D79L+Y82F+S87G+A112P+A126V+D142L;
Y82F+S87G+S70V+D79L+D104P+A112P+D142L;
Y82F+S87G+D79L+D104P+A112P+A126V+D142L;
A27K+D79L+Y82F+S87G+D104P+A112P+A126V+D142L;
A27K+Y82F+S87G+D104P+A112P+A126V+D142L;
A27K+D79L+Y82F+D104P+A112P+A126V+D142L;
A27K+Y82F+D104P+A112P+A126V+D142L;
A27K+D79L+S87P+A112P+D142L; and
D79L+S87P+D142L.

In one embodiment, the thermostable protease is a variant of the metallo protease disclosed as the mature part of SEQ ID NO: 2 disclosed in WO2003/048353 or the mature part of SEQ ID NO: 1 in WO2010/008841 with one of the following substitutions or combinations of substitutions:

D79L+S87P+A112P+D142L;
D79L+S87P+D142L; and
A27K+D79L+Y82F+S87G+D104P+A112P+A126V+D142L.

In one embodiment, the protease variant has at least 75% identity preferably at least 80%, more preferably at least 85%, more preferably at least 90%, more preferably at least 91%, more preferably at least 92%, even more preferably at least 93%, most preferably at least 94%, and even most preferably at least 95%, such as even at least 96%, at least 97%, at least 98%, at least 99%, but less than 100% identity to the mature part of the polypeptide of SEQ ID NO: 2 disclosed in WO2003/048353 or the mature part of SEQ ID NO: 1 in WO2010/008841.

The thermostable protease may also be derived from any bacterium as long as the protease has the thermostability properties.

In one embodiment, the thermostable protease is derived from a strain of the bacterium *Pyrococcus*, such as a strain of *Pyrococcus furiosus* (pfu protease).

In one embodiment, the protease is one shown as SEQ ID NO: 1 in U.S. Pat. No. 6,358,726-B1 (Takara Shuzo Company).

In one embodiment, the thermostable protease is a protease having a mature polypeptide sequence of at least 80% identity, such as at least 85%, such as at least 90%, such as at least 95%, such as at least 96%, such as at least 97%, such as at least 98%, such as at least 99% identity to SEQ ID NO: 1 in U.S. Pat. No. 6,358,726-1. The *Pyrococcus furiosus* protease can be purchased from Takara Bio, Japan.

The *Pyrococcus furiosus* protease may be a thermostable protease as described in SEQ ID NO: 13 of WO2018/098381. This protease (PfuS) was found to have a thermostability of 110% (80° C./70° C.) and 103% (90° C./70° C.) at pH 4.5 determined.

In one embodiment a thermostable protease used in a process described herein has a thermostability value of more than 20% determined as Relative Activity at 80° C./70° C. determined as described in Example 2 of WO2018/098381.

In one embodiment, the protease has a thermostability of more than 30%, more than 40%, more than 50%, more than 60%, more than 70%, more than 80%, more than 90%, more than 100%, such as more than 105%, such as more than 110%, such as more than 115%, such as more than 120% determined as Relative Activity at 80° C./70° C.

In one embodiment, protease has a thermostability of between 20 and 50%, such as between 20 and 40%, such as 20 and 30% determined as Relative Activity at 80° C./70° C. In one embodiment, the protease has a thermostability between 50 and 115%, such as between 50 and 70%, such as between 50 and 60%, such as between 100 and 120%, such as between 105 and 115% determined as Relative Activity at 80° C./70° C.

In one embodiment, the protease has a thermostability value of more than 10% determined as Relative Activity at 85° C./70° C. determined as described in Example 2 of WO2018/098381.

In one embodiment, the protease has a thermostability of more than 10%, such as more than 12%, more than 14%, more than 16%, more than 18%, more than 20%, more than 30%, more than 40%, more that 50%, more than 60%, more than 70%, more than 80%, more than 90%, more than 100%, more than 110% determined as Relative Activity at 85° C./70° C.

In one embodiment, the protease has a thermostability of between 10% and 50%, such as between 10% and 30%, such as between 10% and 25% determined as Relative Activity at 85° C./70° C.

In one embodiment, the protease has more than 20%, more than 30%, more than 40%, more than 50%, more than 60%, more than 70%, more than 80%, more than 90% determined as Remaining Activity at 80° C.; and/or the protease has more than 20%, more than 30%, more than 40%, more than 50%, more than 60%, more than 70%, more than 80%, more than 90% determined as Remaining Activity at 84° C.

Determination of "Relative Activity" and "Remaining Activity" is done as described in Example 2 of WO2018/098381.

In one embodiment, the protease may have a thermostability for above 90, such as above 100 at 85° C. as determined using the Zein-BCA assay as disclosed in Example 3 of WO2018/098381.

In one embodiment, the protease has a thermostability above 60%, such as above 90%, such as above 100%, such as above 110% at 85° C. as determined using the Zein-BCA assay of WO2018/098381.

In one embodiment, protease has a thermostability between 60-120, such as between 70-120%, such as between 80-120%, such as between 90-120%, such as between 100-120%, such as between 110-120% at 85° C. as determined using the Zein-BCA assay of WO2018/098381.

In one embodiment, the thermostable protease has at least 20%, such as at least 30%, such as at least 40%, such as at least 50%, such as at least 60%, such as at least 70%, such as at least 80%, such as at least 90%, such as at least 95%, such as at least 100% of the activity of the JTP196 protease variant or Protease Pfu determined by the AZCL-casein assay of WO2018/098381, and described herein.

In one embodiment, the thermostable protease has at least 20%, such as at least 30%, such as at least 40%, such as at least 50%, such as at least 60%, such as at least 70%, such as at least 80%, such as at least 90%, such as at least 95%, such as at least 100% of the protease activity of the Protease 196 variant or Protease Pfu determined by the AZCL-casein assay of WO2018/098381, and described herein.

Pullulanases

In some embodiments, a pullulanase is present and/or added in liquefaction step and/or saccharification step, or simultaneous saccharification and fermentation (SSF).

Pullulanases (E.C. 3.2.1.41, pullulan 6-glucano-hydrolase), are debranching enzymes characterized by their ability to hydrolyze the alpha-1,6-glycosidic bonds in, for example, amylopectin and pullulan.

In some embodiments, the fermenting organism comprises a heterologous polynucleotide encoding a pullulanase. Any pullulanase described or referenced herein is contemplated for expression in the fermenting organism.

The pullulanase may be any pullulanase that is suitable for the host cells and/or the methods described herein, such as a naturally occurring pullulanase or a variant thereof that retains pullulanase activity.

In some embodiments, the fermenting organism comprising a heterologous polynucleotide encoding a pullulanase has an increased level of pullulanase activity compared to the host cells without the heterologous polynucleotide encoding the pullulanase, when cultivated under the same conditions. In some embodiments, the fermenting organism has an increased level of pullulanase activity of at least 5%, e.g., at least 10%, at least 15%, at least 20%, at least 25%, at least 50%, at least 100%, at least 150%, at least 200%, at least 300%, or at 500% compared to the fermenting organism without the heterologous polynucleotide encoding the pullulanase, when cultivated under the same conditions.

Exemplary pullulanasees that can be used with the host cells and/or the methods described herein include bacterial, yeast, or filamentous fungal pullulanases, e.g., obtained from any of the microorganisms described or referenced herein, as described supra under the sections related to alpha-amylases.

Contemplated pullulanases include the pullulanases from *Bacillus amyloderamificans* disclosed in U.S. Pat. No. 4,560,651 (hereby incorporated by reference), the pullulanase disclosed as SEQ ID NO: 2 in WO01/151620 (hereby incorporated by reference), the *Bacillus deramificans* disclosed as SEQ ID NO: 4 in WO01/151620 (hereby incorporated by reference), and the pullulanase from *Bacillus acidopullulyticus* disclosed as SEQ ID NO: 6 in WO01/151620 (hereby incorporated by reference) and also described in *FEMS* Mic. Let. (1994) 115, 97-106.

Additional pullulanases contemplated include the pullulanases from *Pyrococcus woesei*, specifically from *Pyrococcus woesei* DSM No. 3773 disclosed in WO92/02614.

In one embodiment, the pullulanase is a family GH57 pullulanase. In one embodiment, the pullulanase includes an X47 domain as disclosed in U.S. 61/289,040 published as WO2011/087836 (which are hereby incorporated by reference). More specifically the pullulanase may be derived from a strain of the genus *Thermococcus*, including *Thermococcus litoralis* and *Thermococcus hydrothermalis*, such as the *Thermococcus hydrothermalis* pullulanase truncated at site X4 right after the X47 domain (i.e., amino acids 1-782). The pullulanase may also be a hybrid of the *Thermococcus litoralis* and *Thermococcus hydrothermalis* pullulanases or a *T. hydrothermalis/T. litoralis* hybrid enzyme with truncation site X4 disclosed in U.S. 61/289,040 published as WO2011/087836 (which is hereby incorporated by reference).

In another embodiment, the pullulanase is one comprising an X46 domain disclosed in WO2011/076123 (Novozymes).

The pullulanase may be added in an effective amount which include the preferred amount of about 0.0001-10 mg enzyme protein per gram DS, preferably 0.0001-0.10 mg enzyme protein per gram DS, more preferably 0.0001-0.010 mg enzyme protein per gram DS.

Pullulanase activity may be determined as NPUN. An Assay for determination of NPUN is described in WO2018/098381.

Suitable commercially available pullulanase products include PROMOZYME D, PROMOZYME™ D2 (Novozymes A/S, Denmark), OPTIMAX L-300 (DuPont-Danisco, USA), and AMANO 8 (Amano, Japan).

In one embodiment, the pullulanase is derived from the *Bacillus subtilis* pullulanase of SEQ ID NO: 114. In one embodiment, the pullulanase is derived from the *Bacillus licheniformis* pullulanase of SEQ ID NO: 115. In one embodiment, the pullulanase is derived from the *Oryza sativa* pullulanase of SEQ ID NO: 116. In one embodiment, the pullulanase is derived from the *Triticum aestivum* pullulanase of SEQ ID NO: 117. In one embodiment, the pullulanase is derived from the *Clostridium phytofermentans* pullulanase of SEQ ID NO: 118. In one embodiment, the pullulanase is derived from the *Streptomyces avermitilis* pullulanase of SEQ ID NO: 119. In one embodiment, the pullulanase is derived from the *Klebsiella pneumoniae* pullulanase of SEQ ID NO: 120.

Additional pullulanases contemplated for use with the present invention can be found in WO2011/153516 (the content of which is incorporated herein).

Additional polynucleotides encoding suitable pullulanases may be obtained from microorganisms of any genus, including those readily available within the UniProtKB database (www.uniprot.org).

The pullulanase coding sequences can also be used to design nucleic acid probes to identify and clone DNA encoding pullulanases from strains of different genera or species, as described supra.

The polynucleotides encoding pullulanases may also be identified and obtained from other sources including microorganisms isolated from nature (e.g., soil, composts, water, etc.) or DNA samples obtained directly from natural materials (e.g., soil, composts, water, etc,) as described supra.

Techniques used to isolate or clone polynucleotides encoding pullulanases are described supra.

In one embodiment, the pullulanase has a mature polypeptide sequence that comprises or consists of the amino acid sequence of any one of the pullulanases described or referenced herein (e.g., any one of SEQ ID NOs: 114-120). In another embodiment, the pullulanase has a mature polypeptide sequence that is a fragment of the any one of the pullulanases described or referenced herein (e.g., any one of SEQ ID NOs: 114-120). In one embodiment, the number of amino acid residues in the fragment is at least 75%, e.g., at least 80%, 85%, 90%, or 95% of the number of amino acid residues in referenced full length pullulanase. In other embodiments, the pullulanase may comprise the catalytic domain of any pullulanase described or referenced herein (e.g., any one of SEQ ID NOs: 114-120).

The pullulanase may be a variant of any one of the pullulanases described supra (e.g., any one of SEQ ID NOs: 114-120). In one embodiment, the pullulanase has a mature polypeptide sequence of at least 60%, e.g., at least 65%, 70%, 75%, 80%, 85%, 90%, 95%, 97%, 98%, 99%, or 100% sequence identity to any one of the pullulanases described supra (e.g., any one of SEQ ID NOs: 114-120).

In one embodiment, the pullulanase has a mature polypeptide sequence that differs by no more than ten amino acids, e.g., by no more than five amino acids, by no more than four amino acids, by no more than three amino acids, by no more than two amino acids, or by one amino acid from the amino acid sequence of any one of the pullulanases described supra (e.g., any one of SEQ ID NOs: 114-120). In one embodiment, the pullulanase has an amino acid substitution, deletion, and/or insertion of one or more (e.g., two, several) of amino acid sequence of any one of the pullulanases described supra (e.g., any one of SEQ ID NOs: 114-120). In some embodiments, the total number of amino acid substitutions, deletions and/or insertions is not more than 10, e.g., not more than 9, 8, 7, 6, 5, 4, 3, 2, or 1.

In some embodiments, the pullulanase has at least 20%, e.g., at least 40%, at least 50%, at least 60%, at least 70%, at least 80%, at least 90%, at least 95%, at least 96%, at least 97%, at least 98%, at least 99%, or 100% of the pullulanase activity of any pullulanase described or referenced herein under the same conditions (e.g., any one of SEQ ID NOs: 114-120).

In one embodiment, the pullulanase coding sequence hybridizes under at least low stringency conditions, e.g., medium stringency conditions, medium-high stringency conditions, high stringency conditions, or very high stringency conditions with the full-length complementary strand of the coding sequence from any pullulanase described or referenced herein (e.g., any one of SEQ ID NOs: 114-120). In one embodiment, the pullulanase coding sequence has at least 65%, e.g., at least 70%, at least 75%, at least 80%, at least 85%, at least 85%, at least 90%, at least 91%, at least 92%, at least 93%, at least 94%, at least 95%, at least 96%, at least 97%, at least 98%, at least 99%, or 100% sequence identity with the coding sequence from any pullulanase described or referenced herein (e.g., any one of SEQ ID NOs: 114-120).

In one embodiment, the pullulanase comprises the coding sequence of any pullulanase described or referenced herein (e.g., any one of SEQ ID NOs: 114-120). In one embodiment, the pullulanase comprises a coding sequence that is a subsequence of the coding sequence from any pullulanase described or referenced herein, wherein the subsequence encodes a polypeptide having pullulanase activity. In one embodiment, the number of nucleotides residues in the subsequence is at least 75%, e.g., at least 80%, 85%, 90%, or 95% of the number of the referenced coding sequence.

The referenced coding sequence of any related aspect or embodiment described herein can be the native coding sequence or a degenerate sequence, such as a codon-optimized coding sequence designed for use in a particular host cell (e.g., optimized for expression in *Saccharomyces cerevisiae*).

The pullulanase can also include fused polypeptides or cleavable fusion polypeptides, as described supra.

Methods using a Cellulosic-Containing Material

In some aspects, the methods described herein produce a fermentation product from a cellulosic-containing material. The predominant polysaccharide in the primary cell wall of biomass is cellulose, the second most abundant is hemicellulose, and the third is pectin. The secondary cell wall, produced after the cell has stopped growing, also contains polysaccharides and is strengthened by polymeric lignin covalently cross-linked to hemicellulose. Cellulose is a homopolymer of anhydrocellobiose and thus a linear beta-(1-4)-D-glucan, while hemicelluloses include a variety of compounds, such as xylans, xyloglucans, arabinoxylans, and mannans in complex branched structures with a spectrum of substituents. Although generally polymorphous, cellulose is found in plant tissue primarily as an insoluble crystalline matrix of parallel glucan chains. Hemicelluloses usually hydrogen bond to cellulose, as well as to other hemicelluloses, which help stabilize the cell wall matrix.

Cellulose is generally found, for example, in the stems, leaves, hulls, husks, and cobs of plants or leaves, branches, and wood of trees. The cellulosic-containing material can be, but is not limited to, agricultural residue, herbaceous material (including energy crops), municipal solid waste, pulp and paper mill residue, waste paper, and wood (including forestry residue) (see, for example, Wiselogel et al., 1995, in Handbook on Bioethanol (Charles E. Wyman, editor), pp. 105-118, Taylor & Francis, Washington D.C.; Wyman, 1994, *Bioresource Technology* 50: 3-16; Lynd, 1990, *Applied Biochemistry and Biotechnology* 24/25: 695-719; Mosier et al., 1999, Recent Progress in Bioconversion of Lignocellulosics, in *Advances in Biochemical Engineering/Biotechnology*, T. Scheper, managing editor, Volume 65, pp. 23-40, Springer-Verlag, New York). It is understood herein that the cellulose may be in the form of lignocellulose, a plant cell wall material containing lignin, cellulose, and hemicellulose in a mixed matrix. In one embodiment, the cellulosic-containing material is any biomass material.

In another embodiment, the cellulosic-containing material is lignocellulose, which comprises cellulose, hemicelluloses, and lignin.

In one embodiment, the cellulosic-containing material is agricultural residue, herbaceous material (including energy crops), municipal solid waste, pulp and paper mill residue, waste paper, or wood (including forestry residue).

In another embodiment, the cellulosic-containing material is arundo, bagasse, bamboo, corn cob, corn fiber, corn stover, miscanthus, rice straw, switchgrass, or wheat straw.

In another embodiment, the cellulosic-containing material is aspen, eucalyptus, fir, pine, poplar, spruce, or willow.

In another embodiment, the cellulosic-containing material is algal cellulose, bacterial cellulose, cotton linter, filter paper, microcrystalline cellulose (e.g., AVICEL®), or phosphoric-acid treated cellulose.

In another embodiment, the cellulosic-containing material is an aquatic biomass. As used herein the term "aquatic biomass" means biomass produced in an aquatic environment by a photosynthesis process. The aquatic biomass can be algae, emergent plants, floating-leaf plants, or submerged plants.

The cellulosic-containing material may be used as is or may be subjected to pretreatment, using conventional methods known in the art, as described herein. In a preferred embodiment, the cellulosic-containing material is pretreated.

The methods of using cellulosic-containing material can be accomplished using methods conventional in the art. Moreover, the methods of can be implemented using any conventional biomass processing apparatus configured to carry out the processes.

Cellulosic Pretreatment

In one embodiment the cellulosic-containing material is pretreated before saccharification.

In practicing the processes described herein, any pretreatment process known in the art can be used to disrupt plant cell wall components of the cellulosic-containing material (Chandra et al., 2007, *Adv. Biochem. Engin./Biotechnol.* 108: 67-93; Galbe and Zacchi, 2007, *Adv. Biochem. Engin./Biotechnol.* 108: 41-65; Hendriks and Zeeman, 2009, *Bioresource Technology* 100: 10-18; Mosier et al., 2005, *Bioresource Technology* 96: 673-686; Taherzadeh and Karimi, 2008, *Int. J. Mol. Sci.* 9: 1621-1651; Yang and Wyman, 2008, *Biofuels Bioproducts and Biorefining-Biofpr.* 2: 26-40).

The cellulosic-containing material can also be subjected to particle size reduction, sieving, pre-soaking, wetting, washing, and/or conditioning prior to pretreatment using methods known in the art.

Conventional pretreatments include, but are not limited to, steam pretreatment (with or without explosion), dilute acid pretreatment, hot water pretreatment, alkaline pretreatment, lime pretreatment, wet oxidation, wet explosion, ammonia fiber explosion, organosolv pretreatment, and biological pretreatment. Additional pretreatments include ammonia percolation, ultrasound, electroporation, microwave, supercritical $CO_2$, supercritical $H_2O$, ozone, ionic liquid, and gamma irradiation pretreatments.

In a one embodiment, the cellulosic-containing material is pretreated before saccharification (i.e., hydrolysis) and/or fermentation. Pretreatment is preferably performed prior to the hydrolysis. Alternatively, the pretreatment can be carried out simultaneously with enzyme hydrolysis to release fermentable sugars, such as glucose, xylose, and/or cellobiose. In most cases the pretreatment step itself results in some conversion of biomass to fermentable sugars (even in absence of enzymes).

In one embodiment, the cellulosic-containing material is pretreated with steam. In steam pretreatment, the cellulosic-containing material is heated to disrupt the plant cell wall components, including lignin, hemicellulose, and cellulose to make the cellulose and other fractions, e.g., hemicellulose, accessible to enzymes. The cellulosic-containing material is passed to or through a reaction vessel where steam is injected to increase the temperature to the required temperature and pressure and is retained therein for the desired reaction time. Steam pretreatment is preferably performed at 140-250° C., e.g., 160-200° C. or 170-190° C., where the optimal temperature range depends on optional addition of a chemical catalyst. Residence time for the steam pretreatment is preferably 1-60 minutes, e.g., 1-30 minutes, 1-20 minutes, 3-12 minutes, or 4-10 minutes, where the optimal residence time depends on the temperature and optional addition of a chemical catalyst. Steam pretreatment allows for relatively high solids loadings, so that the cellulosic-containing material is generally only moist during the pretreatment. The steam pretreatment is often combined with an explosive discharge of the material after the pretreatment, which is known as steam explosion, that is, rapid flashing to atmospheric pressure and turbulent flow of the material to increase the accessible surface area by fragmentation (Duff and Murray, 1996, *Bioresource Technology* 855: 1-33; Galbe and Zacchi, 2002, *Appl. Microbiol. Biotechnol.* 59: 618-628; U.S. Patent Application No. 2002/0164730). During steam pretreatment, hemicellulose acetyl groups are cleaved and the resulting acid autocatalyzes partial hydrolysis of the hemicellulose to monosaccharides and oligosaccharides. Lignin is removed to only a limited extent.

In one embodiment, the cellulosic-containing material is subjected to a chemical pretreatment. The term "chemical treatment" refers to any chemical pretreatment that promotes the separation and/or release of cellulose, hemicellulose, and/or lignin. Such a pretreatment can convert crystalline cellulose to amorphous cellulose. Examples of suitable chemical pretreatment processes include, for example, dilute acid pretreatment, lime pretreatment, wet oxidation, ammonia fiber/freeze expansion (AFEX), ammonia percolation (APR), ionic liquid, and organosolv pretreatments.

A chemical catalyst such as $H_2SO_4$ or $SO_2$ (typically 0.3 to 5% w/w) is sometimes added prior to steam pretreatment, which decreases the time and temperature, increases the recovery, and improves enzymatic hydrolysis (Ballesteros et al., 2006, *Appl. Biochem. Biotechnol.* 129-132: 496-508; Varga et al., 2004, *Appl. Biochem. Biotechnol.* 113-116: 509-523; Sassner et al., 2006, *Enzyme Microb. Technol.* 39: 756-762). In dilute acid pretreatment, the cellulosic-containing material is mixed with dilute acid, typically $H_2SO_4$, and water to form a slurry, heated by steam to the desired temperature, and after a residence time flashed to atmospheric pressure. The dilute acid pretreatment can be performed with a number of reactor designs, e.g., plug-flow reactors, counter-current reactors, or continuous counter-current shrinking bed reactors (Duff and Murray, 1996, *Bioresource Technology* 855: 1-33; Schell et al., 2004, *Bioresource Technology* 91: 179-188; Lee et al., 1999, *Adv. Biochem. Eng. Biotechnol.* 65: 93-115). In a specific embodiment the dilute acid pretreatment of cellulosic-containing material is carried out using 4% w/w sulfuric acid at 180° C. for 5 minutes.

Several methods of pretreatment under alkaline conditions can also be used. These alkaline pretreatments include, but are not limited to, sodium hydroxide, lime, wet oxidation, ammonia percolation (APR), and ammonia fiber/freeze expansion (AFEX) pretreatment. Lime pretreatment is performed with calcium oxide or calcium hydroxide at temperatures of 85-150° C. and residence times from 1 hour to several days (Wyman et al., 2005, *Bioresource Technology* 96: 1959-1966; Mosier et al., 2005, *Bioresource Technology* 96: 673-686). WO2006/110891, WO2006/110899, WO2006/110900, and WO2006/110901 disclose pretreatment methods using ammonia.

Wet oxidation is a thermal pretreatment performed typically at 180-200° C. for 5-15 minutes with addition of an oxidative agent such as hydrogen peroxide or over-pressure of oxygen (Schmidt and Thomsen, 1998, *Bioresource Technology* 64: 139-151; Palonen et al., 2004, *Appl. Biochem. Biotechnol.* 117: 1-17; Varga et al., 2004, *Biotechnol. Bioeng.* 88: 567-574; Martin et al., 2006, *J. Chem. Technol. Biotechnol.* 81: 1669-1677). The pretreatment is performed preferably at 1-40% dry matter, e.g., 2-30% dry matter or 5-20% dry matter, and often the initial pH is increased by the addition of alkali such as sodium carbonate.

A modification of the wet oxidation pretreatment method, known as wet explosion (combination of wet oxidation and steam explosion) can handle dry matter up to 30%. In wet explosion, the oxidizing agent is introduced during pretreatment after a certain residence time. The pretreatment is then ended by flashing to atmospheric pressure (WO2006/032282).

Ammonia fiber expansion (AFEX) involves treating the cellulosic-containing material with liquid or gaseous ammonia at moderate temperatures such as 90-150° C. and high pressure such as 17-20 bar for 5-10 minutes, where the dry matter content can be as high as 60% (Gollapalli et al., 2002, *Appl. Biochem. Biotechnol.* 98: 23-35; Chundawat et al., 2007, *Biotechnol. Bioeng.* 96: 219-231; Alizadeh et al., 2005, *Appl. Biochem. Biotechnol.* 121: 1133-1141; Teymouri et al., 2005, *Bioresource Technology* 96: 2014-2018). During AFEX pretreatment cellulose and hemicelluloses remain relatively intact. Lignin-carbohydrate complexes are cleaved.

Organosolv pretreatment delignifies the cellulosic-containing material by extraction using aqueous ethanol (40-60% ethanol) at 160-200° C. for 30-60 minutes (Pan et al., 2005, *Biotechnol. Bioeng.* 90: 473-481; Pan et al., 2006, *Biotechnol. Bioeng.* 94: 851-861; Kurabi et al., 2005, *Appl. Biochem. Biotechnol.* 121: 219-230). Sulphuric acid is usually added as a catalyst. In organosolv pretreatment, the majority of hemicellulose and lignin is removed.

Other examples of suitable pretreatment methods are described by Schell et al., 2003, *Appl. Biochem. Biotechnol.* 105-108: 69-85, and Mosier et al., 2005, *Bioresource Technology* 96: 673-686, and U.S. Published Application 2002/0164730.

In one embodiment, the chemical pretreatment is carried out as a dilute acid treatment, and more preferably as a continuous dilute acid treatment. The acid is typically sulfuric acid, but other acids can also be used, such as acetic acid, citric acid, nitric acid, phosphoric acid, tartaric acid, succinic acid, hydrogen chloride, or mixtures thereof. Mild acid treatment is conducted in the pH range of preferably 1-5, e.g., 1-4 or 1-2.5. In one aspect, the acid concentration is in the range from preferably 0.01 to 10 wt. % acid, e.g., 0.05 to 5 wt. % acid or 0.1 to 2 wt. % acid. The acid is contacted with the cellulosic-containing material and held at a temperature in the range of preferably 140-200° C., e.g., 165-190° C., for periods ranging from 1 to 60 minutes.

In another embodiment, pretreatment takes place in an aqueous slurry. In preferred aspects, the cellulosic-containing material is present during pretreatment in amounts preferably between 10-80 wt. %, e.g., 20-70 wt. % or 30-60 wt. %, such as around 40 wt. %. The pretreated cellulosic-containing material can be unwashed or washed using any method known in the art, e.g., washed with water.

In one embodiment, the cellulosic-containing material is subjected to mechanical or physical pretreatment. The term "mechanical pretreatment" or "physical pretreatment" refers to any pretreatment that promotes size reduction of particles. For example, such pretreatment can involve various types of grinding or milling (e.g., dry milling, wet milling, or vibratory ball milling).

The cellulosic-containing material can be pretreated both physically (mechanically) and chemically. Mechanical or physical pretreatment can be coupled with steaming/steam explosion, hydrothermolysis, dilute or mild acid treatment, high temperature, high pressure treatment, irradiation (e.g., microwave irradiation), or combinations thereof. In one aspect, high pressure means pressure in the range of preferably about 100 to about 400 psi, e.g., about 150 to about 250 psi. In another aspect, high temperature means temperature in the range of about 100 to about 300° C., e.g., about 140 to about 200° C. In a preferred aspect, mechanical or physical pretreatment is performed in a batch-process using a steam gun hydrolyzer system that uses high pressure and high temperature as defined above, e.g., a Sunds Hydrolyzer available from Sunds Defibrator AB, Sweden. The physical and chemical pretreatments can be carried out sequentially or simultaneously, as desired.

Accordingly, in one embodiment, the cellulosic-containing material is subjected to physical (mechanical) or chemical pretreatment, or any combination thereof, to promote the separation and/or release of cellulose, hemicellulose, and/or lignin.

In one embodiment, the cellulosic-containing material is subjected to a biological pretreatment. The term "biological pretreatment" refers to any biological pretreatment that promotes the separation and/or release of cellulose, hemicellulose, and/or lignin from the cellulosic-containing material. Biological pretreatment techniques can involve applying lignin-solubilizing microorganisms and/or enzymes (see, for example, Hsu, T.-A., 1996, Pretreatment of biomass, in *Handbook on Bioethanol: Production and Utilization*, Wyman, C. E., ed., Taylor & Francis, Washington, DC, 179-212; Ghosh and Singh, 1993, *Adv. Appl. Microbiol.* 39: 295-333; McMillan, J. D., 1994, Pretreating lignocellulosic biomass: a review, in *Enzymatic Conversion of Biomass for Fuels Production*, Himmel, M. E., Baker, J. O., and Overend, R. P., eds., ACS Symposium Series 566, American Chemical Society, Washington, DC, chapter 15; Gong, C. S., Cao, N. J., Du, J., and Tsao, G. T., 1999, Ethanol production from renewable resources, in *Advances in Biochemical Engineering/Biotechnology*, Scheper, T., ed., Springer-Verlag Berlin Heidelberg, Germany, 65: 207-241; Olsson and Hahn-Hagerdal, 1996, *Enz. Microb. Tech.* 18: 312-331; and Vallander and Eriksson, 1990, *Adv. Biochem.* Eng./*Biotechnol.* 42: 63-95).

Saccharification and Fermentation of Cellulosic-Containing Material

Saccharification (i.e., hydrolysis) and fermentation, separate or simultaneous, include, but are not limited to, separate hydrolysis and fermentation (SHF); simultaneous saccharification and fermentation (SSF); simultaneous saccharification and co-fermentation (SSCF); hybrid hydrolysis and fermentation (HHF); separate hydrolysis and co-fermentation (SHCF); hybrid hydrolysis and co-fermentation (HHCF).

SHF uses separate process steps to first enzymatically hydrolyze the cellulosic-containing material to fermentable sugars, e.g., glucose, cellobiose, and pentose monomers, and then ferment the fermentable sugars to ethanol. In SSF, the enzymatic hydrolysis of the cellulosic-containing material and the fermentation of sugars to ethanol are combined in one step (Philippidis, G. P., 1996, Cellulose bioconversion technology, in *Handbook on Bioethanol: Production and Utilization*, Wyman, C. E., ed., Taylor & Francis, Washington, DC, 179-212). SSCF involves the co-fermentation of multiple sugars (Sheehan and Himmel, 1999, *Biotechnol. Prog.* 15: 817-827). HHF involves a separate hydrolysis step, and in addition a simultaneous saccharification and hydrolysis step, which can be carried out in the same reactor. The steps in an HHF process can be carried out at different temperatures, i.e., high temperature enzymatic saccharification followed by SSF at a lower temperature that the fermentation organism can tolerate. It is understood herein that any method known in the art comprising pretreatment, enzymatic hydrolysis (saccharification), fermentation, or a combination thereof, can be used in the practicing the processes described herein.

A conventional apparatus can include a fed-batch stirred reactor, a batch stirred reactor, a continuous flow stirred reactor with ultrafiltration, and/or a continuous plug-flow column reactor (de Castilhos Corazza et al., 2003, *Acta Scientiarum. Technology* 25: 33-38; Gusakov and Sinitsyn, 1985, *Enz. Microb. Technol.* 7: 346-352), an attrition reactor (Ryu and Lee, 1983, *Biotechnol. Bioeng.* 25: 53-65). Additional reactor types include fluidized bed, upflow blanket, immobilized, and extruder type reactors for hydrolysis and/or fermentation.

In the saccharification step (i.e., hydrolysis step), the cellulosic and/or starch-containing material, e.g., pretreated, is hydrolyzed to break down cellulose, hemicellulose, and/or starch to fermentable sugars, such as glucose, cellobiose, xylose, xylulose, arabinose, mannose, galactose, and/or soluble oligosaccharides. The hydrolysis is performed enzymatically e.g., by a cellulolytic enzyme composition. The enzymes of the compositions can be added simultaneously or sequentially.

Enzymatic hydrolysis may be carried out in a suitable aqueous environment under conditions that can be readily determined by one skilled in the art. In one aspect, hydrolysis is performed under conditions suitable for the activity of the enzymes(s), i.e., optimal for the enzyme(s). The hydrolysis can be carried out as a fed batch or continuous process where the cellulosic and/or starch-containing material is fed gradually to, for example, an enzyme containing hydrolysis solution.

The saccharification is generally performed in stirred-tank reactors or fermentors under controlled pH, temperature, and mixing conditions. Suitable process time, temperature and pH conditions can readily be determined by one skilled in the art. For example, the saccharification can last up to 200 hours, but is typically performed for preferably about 12 to about 120 hours, e.g., about 16 to about 72 hours or about 24 to about 48 hours. The temperature is in the range of preferably about 25° C. to about 70° C., e.g., about 30° C. to about 65° C., about 40° C. to about 60° C., or about 50° C. to about 55° C. The pH is in the range of preferably about 3 to about 8, e.g., about 3.5 to about 7, about 4 to about 6, or about 4.5 to about 5.5. The dry solids content is in the range of preferably about 5 to about 50 wt. %, e.g., about 10 to about 40 wt. % or about 20 to about 30 wt. %.

Saccharification in may be carried out using a cellulolytic enzyme composition. Such enzyme compositions are described below in the "Cellulolytic Enzyme Composition'-section below. The cellulolytic enzyme compositions can comprise any protein useful in degrading the cellulosic-containing material. In one aspect, the cellulolytic enzyme composition comprises or further comprises one or more (e.g., several) proteins selected from the group consisting of a cellulase, an AA9 (GH61) polypeptide, a hemicellulase, an esterase, an expansin, a ligninolytic enzyme, an oxidoreductase, a pectinase, a protease, and a swollenin.

In another embodiment, the cellulase is preferably one or more (e.g., several) enzymes selected from the group consisting of an endoglucanase, a cellobiohydrolase, and a beta-glucosidase.

In another embodiment, the hemicellulase is preferably one or more (e.g., several) enzymes selected from the group consisting of an acetylmannan esterase, an acetylxylan esterase, an arabinanase, an arabinofuranosidase, a coumaric acid esterase, a feruloyl esterase, a galactosidase, a glucuronidase, a glucuronoyl esterase, a mannanase, a mannosidase, a xylanase, and a xylosidase. In another embodiment, the oxidoreductase is one or more (e.g., several) enzymes selected from the group consisting of a catalase, a laccase, and a peroxidase.

The enzymes or enzyme compositions used in a processes of the present invention may be in any form suitable for use, such as, for example, a fermentation broth formulation or a cell composition, a cell lysate with or without cellular debris, a semi-purified or purified enzyme preparation, or a host cell as a source of the enzymes. The enzyme composition may be a dry powder or granulate, a non-dusting granulate, a liquid, a stabilized liquid, or a stabilized protected enzyme. Liquid enzyme preparations may, for instance, be stabilized by adding stabilizers such as a sugar, a sugar alcohol or another polyol, and/or lactic acid or another organic acid according to established processes.

In one embodiment, an effective amount of cellulolytic or hemicellulolytic enzyme composition to the cellulosic-containing material is about 0.5 to about 50 mg, e.g., about 0.5 to about 40 mg, about 0.5 to about 25 mg, about 0.75 to about 20 mg, about 0.75 to about 15 mg, about 0.5 to about 10 mg, or about 2.5 to about 10 mg per g of the cellulosic-containing material.

In one embodiment, such a compound is added at a molar ratio of the compound to glucosyl units of cellulose of about $10^{-6}$ to about 10, e.g., about $10^{-6}$ to about 7.5, about $10^{-6}$ to about 5, about $10^{-6}$ to about 2.5, about $10^{-6}$ to about 1, about $10^{-5}$ to about 1, about $10^{-5}$ to about $10^{-1}$, about $10^{-4}$ to about $10^{-1}$, about $10^{-3}$ to about $10^{-1}$, or about $10^{-3}$ to about $10^{-2}$. In another aspect, an effective amount of such a compound is about 0.1 µM to about 1 M, e.g., about 0.5 µM to about 0.75 M, about 0.75 µM to about 0.5 M, about 1 µM to about 0.25 M, about 1 µM to about 0.1 M, about 5 µM to about 50 mM, about 10 µM to about 25 mM, about 50 µM to about 25 mM, about 10 µM to about 10 mM, about 5 µM to about 5 mM, or about 0.1 mM to about 1 mM.

The term "liquor" means the solution phase, either aqueous, organic, or a combination thereof, arising from treatment of a lignocellulose and/or hemicellulose material in a slurry, or monosaccharides thereof, e.g., xylose, arabinose, mannose, etc., under conditions as described in WO2012/021401, and the soluble contents thereof. A liquor for cellulolytic enhancement of an AA9 polypeptide (GH61 polypeptide) can be produced by treating a lignocellulose or hemicellulose material (or feedstock) by applying heat and/or pressure, optionally in the presence of a catalyst, e.g., acid, optionally in the presence of an organic solvent, and optionally in combination with physical disruption of the material, and then separating the solution from the residual solids. Such conditions determine the degree of cellulolytic enhancement obtainable through the combination of liquor and an AA9 polypeptide during hydrolysis of a cellulosic substrate by a cellulolytic enzyme preparation. The liquor can be separated from the treated material using a method standard in the art, such as filtration, sedimentation, or centrifugation.

In one embodiment, an effective amount of the liquor to cellulose is about $10^{-6}$ to about 10 g per g of cellulose, e.g., about $10^{-6}$ to about 7.5 g, about $10^{-6}$ to about 5 g, about $10^{-6}$ to about 2.5 g, about $10^{-6}$ to about 1 g, about $10^{-5}$ to about 1 g, about $10^{-5}$ to about $10^{-1}$ g, about $10^{-4}$ to about $10^{-1}$ g, about $10^{-3}$ to about $10^{-1}$ g, or about $10^{-3}$ to about $10^{-2}$ g per g of cellulose.

In the fermentation step, sugars, released from the cellulosic-containing material, e.g., as a result of the pretreatment and enzymatic hydrolysis steps, are fermented to ethanol, by a fermenting organism, such as yeast described herein. Hydrolysis (saccharification) and fermentation can be separate or simultaneous.

Any suitable hydrolyzed cellulosic-containing material can be used in the fermentation step in practicing the processes described herein. Such feedstocks include, but are not limited to carbohydrates (e.g., lignocellulose, xylans, cellulose, starch, etc.). The material is generally selected based on economics, i.e., costs per equivalent sugar potential, and recalcitrance to enzymatic conversion.

Production of ethanol by a fermenting organism using cellulosic-containing material results from the metabolism of sugars (monosaccharides). The sugar composition of the hydrolyzed cellulosic-containing material and the ability of the fermenting organism to utilize the different sugars has a direct impact in process yields. Prior to Applicant's disclosure herein, strains known in the art utilize glucose efficiently but do not (or very limitedly) metabolize pentoses like xylose, a monosaccharide commonly found in hydrolyzed material.

Compositions of the fermentation media and fermentation conditions depend on the fermenting organism and can easily be determined by one skilled in the art. Typically, the fermentation takes place under conditions known to be suitable for generating the fermentation product. In some embodiments, the fermentation process is carried out under aerobic or microaerophilic (i.e., where the concentration of oxygen is less than that in air), or anaerobic conditions. In some embodiments, fermentation is conducted under anaerobic conditions (i.e., no detectable oxygen), or less than about 5, about 2.5, or about 1 mmol/L/h oxygen. In the absence of oxygen, the NADH produced in glycolysis cannot be oxidized by oxidative phosphorylation. Under anaerobic conditions, pyruvate or a derivative thereof may be utilized by the host cell as an electron and hydrogen acceptor in order to generate NAD+.

The fermentation process is typically run at a temperature that is optimal for the recombinant fungal cell. For example, in some embodiments, the fermentation process is performed at a temperature in the range of from about 25° C. to about 42° C. Typically the process is carried out a temperature that is less than about 38° C., less than about 35° C., less than about 33° C., or less than about 38° C., but at least about 20° C., 22° C., or 25° C.

A fermentation stimulator can be used in a process described herein to further improve the fermentation, and in particular, the performance of the fermenting organism, such as, rate enhancement and product yield (e.g., ethanol yield). A "fermentation stimulator" refers to stimulators for growth of the fermenting organisms, in particular, yeast. Preferred fermentation stimulators for growth include vitamins and minerals. Examples of vitamins include multivitamins, biotin, pantothenate, nicotinic acid, meso-inositol, thiamine, pyridoxine, para-aminobenzoic acid, folic acid, riboflavin, and Vitamins A, B, C, D, and E. See, for example, Alfenore et al., Improving ethanol production and viability of *Saccharomyces cerevisiae* by a vitamin feeding strategy during fed-batch process, Springer-Verlag (2002), which is hereby incorporated by reference. Examples of minerals include minerals and mineral salts that can supply nutrients comprising P, K, Mg, S, Ca, Fe, Zn, Mn, and Cu.

Cellulolytic Enzymes and Compositions

A cellulolytic enzyme or cellulolytic enzyme composition may be present and/or added during saccharification. A cellulolytic enzyme composition is an enzyme preparation containing one or more (e.g., several) enzymes that hydrolyze cellulosic-containing material. Such enzymes include endoglucanase, cellobiohydrolase, beta-glucosidase, and/or combinations thereof.

In some embodiments, the fermenting organism comprises one or more (e.g., several) heterologous polynucleotides encoding enzymes that hydrolyze cellulosic-containing material (e.g., an endoglucanase, cellobiohydrolase, beta-glucosidase or combinations thereof). Any enzyme described or referenced herein that hydrolyzes cellulosic-containing material is contemplated for expression in the fermenting organism.

The cellulolytic enzyme may be any cellulolytic enzyme that is suitable for the host cells and/or the methods described herein (e.g., an endoglucanase, cellobiohydrolase, beta-glucosidase), such as a naturally occurring cellulolytic enzyme or a variant thereof that retains cellulolytic enzyme activity.

In some embodiments, the fermenting organism comprising a heterologous polynucleotide encoding a cellulolytic enzyme has an increased level of cellulolytic enzyme activity (e.g., increased endoglucanase, cellobiohydrolase, and/or beta-glucosidase) compared to the host cells without the heterologous polynucleotide encoding the cellulolytic enzyme, when cultivated under the same conditions. In some embodiments, the fermenting organism has an increased level of cellulolytic enzyme activity of at least 5%, e.g., at least 10%, at least 15%, at least 20%, at least 25%, at least 50%, at least 100%, at least 150%, at least 200%, at least 300%, or at 500% compared to the fermenting organism without the heterologous polynucleotide encoding the cellulolytic enzyme, when cultivated under the same conditions.

Exemplary cellulolytic enzymes that can be used with the host cells and/or the methods described herein include bacterial, yeast, or filamentous fungal cellulolytic enzymes, e.g., obtained from any of the microorganisms described or referenced herein, as described supra under the sections related to proteases.

The cellulolytic enzyme may be of any origin. In an embodiment the cellulolytic enzyme is derived from a strain of *Trichoderma*, such as a strain of *Trichoderma reesei*; a strain of *Humicola*, such as a strain of *Humicola insolens*, and/or a strain of *Chrysosporium*, such as a strain of *Chrysosporium lucknowense*. In a preferred embodiment the cellulolytic enzyme is derived from a strain of *Trichoderma reesei*.

The cellulolytic enzyme composition may further comprise one or more of the following polypeptides, such as enzymes: AA9 polypeptide (GH61 polypeptide) having cellulolytic enhancing activity, beta-glucosidase, xylanase, beta-xylosidase, CBH I, CBH II, or a mixture of two, three, four, five or six thereof.

The further polypeptide(s) (e.g., AA9 polypeptide) and/or enzyme(s) (e.g., beta-glucosidase, xylanase, beta-xylosidase, CBH I and/or CBH II may be foreign to the cellulolytic enzyme composition producing organism (e.g., *Trichoderma reesei*).

In an embodiment the cellulolytic enzyme composition comprises an AA9 polypeptide having cellulolytic enhancing activity and a beta-glucosidase.

In another embodiment the cellulolytic enzyme composition comprises an AA9 polypeptide having cellulolytic enhancing activity, a beta-glucosidase, and a CBH I.

In another embodiment the cellulolytic enzyme composition comprises an AA9 polypeptide having cellulolytic enhancing activity, a beta-glucosidase, a CBH I and a CBH II. Other enzymes, such as endoglucanases, may also be comprised in the cellulolytic enzyme composition.

As mentioned above the cellulolytic enzyme composition may comprise a number of difference polypeptides, including enzymes.

In one embodiment, the cellulolytic enzyme composition is a *Trichoderma reesei* cellulolytic enzyme composition, further comprising *Thermoascus aurantiacus* AA9 (GH61A) polypeptide having cellulolytic enhancing activity (e.g., WO2005/074656), and *Aspergillus oryzae* beta-glucosidase fusion protein (e.g., one disclosed in WO2008/057637, in particular shown as SEQ ID NOs: 59 and 60).

In another embodiment the cellulolytic enzyme composition is a *Trichoderma reesei* cellulolytic enzyme composition, further comprising *Thermoascus aurantiacus* AA9 (GH61A) polypeptide having cellulolytic enhancing activity (e.g., SEQ ID NO: 2 in WO2005/074656), and *Aspergillus fumigatus* beta-glucosidase (e.g., SEQ ID NO: 2 of WO2005/047499).

In another embodiment the cellulolytic enzyme composition is a *Trichoderma reesei* cellulolytic enzyme composition, further comprising *Penicillium emersonii* AA9 (GH61A) polypeptide having cellulolytic enhancing activity, in particular the one disclosed in WO2011/041397, and *Aspergillus fumigatus* beta-glucosidase (e.g., SEQ ID NO: 2 of WO2005/047499).

In another embodiment the cellulolytic enzyme composition is a *Trichoderma reesei* cellulolytic enzyme composition, further comprising *Penicillium emersonii* AA9 (GH61A) polypeptide having cellulolytic enhancing activity, in particular the one disclosed in WO2011/041397, and *Aspergillus fumigatus* beta-glucosidase (e.g., SEQ ID NO: 2 of WO2005/047499) or a variant disclosed in WO2012/044915 (hereby incorporated by reference), in particular one comprising one or more such as all of the following substitutions: F100D, S283G, N456E, F512Y.

In an embodiment the cellulolytic enzyme composition is a *Trichoderma reesei* cellulolytic composition, further comprising an AA9 (GH61A) polypeptide having cellulolytic enhancing activity, in particular the one derived from a strain of *Penicillium emersonii* (e.g., SEQ ID NO: 2 in WO2011/041397), *Aspergillus fumigatus* beta-glucosidase (e.g., SEQ ID NO: 2 in WO2005/047499) variant with one or more, in particular all of the following substitutions: F100D, S283G, N456E, F512Y and disclosed in WO2012/044915; *Aspergillus fumigatus* Cel7A CBH1, e.g., the one disclosed as SEQ ID NO: 6 in WO2011/057140 and *Aspergillus fumigatus* CBH II, e.g., the one disclosed as SEQ ID NO: 18 in WO2011/057140.

In a preferred embodiment the cellulolytic enzyme composition is a *Trichoderma reesei*, cellulolytic enzyme composition, further comprising a hemicellulase or hemicellulolytic enzyme composition, such as an *Aspergillus fumigatus* xylanase and *Aspergillus fumigatus* beta-xylosidase.

In an embodiment the cellulolytic enzyme composition also comprises a xylanase (e.g., derived from a strain of the genus *Aspergillus*, in particular *Aspergillus aculeatus* or *Aspergillus fumigatus*; or a strain of the genus *Talaromyces*, in particular *Talaromyces leycettanus*) and/or a beta-xylosidase (e.g., derived from *Aspergillus*, in particular *Aspergillus fumigatus*, or a strain of *Talaromyces*, in particular *Talaromyces emersonii*).

In an embodiment the cellulolytic enzyme composition is a *Trichoderma reesei* cellulolytic enzyme composition, further comprising *Thermoascus aurantiacus* AA9 (GH61A) polypeptide having cellulolytic enhancing activity (e.g., WO2005/074656), *Aspergillus oryzae* beta-glucosidase fusion protein (e.g., one disclosed in WO2008/057637, in particular as SEQ ID NOs: 59 and 60), and *Aspergillus aculeatus* xylanase (e.g., Xyl II in WO94/21785).

In another embodiment the cellulolytic enzyme composition comprises a *Trichoderma reesei* cellulolytic preparation, further comprising *Thermoascus aurantiacus* GH61A polypeptide having cellulolytic enhancing activity (e.g., SEQ ID NO: 2 in WO2005/074656), *Aspergillus fumigatus* beta-glucosidase (e.g., SEQ ID NO: 2 of WO2005/047499) and *Aspergillus aculeatus* xylanase (Xyl II disclosed in WO94/21785).

In another embodiment the cellulolytic enzyme composition comprises a *Trichoderma reesei* cellulolytic enzyme composition, further comprising *Thermoascus aurantiacus* AA9 (GH61A) polypeptide having cellulolytic enhancing activity (e.g., SEQ ID NO: 2 in WO2005/074656), *Aspergillus fumigatus* beta-glucosidase (e.g., SEQ ID NO: 2 of WO2005/047499) and *Aspergillus aculeatus* xylanase (e.g., Xyl II disclosed in WO94/21785).

In another embodiment the cellulolytic enzyme composition is a *Trichoderma reesei* cellulolytic enzyme composition, further comprising *Penicillium emersonii* AA9 (GH61A) polypeptide having cellulolytic enhancing activity, in particular the one disclosed in WO2011/041397, *Aspergillus fumigatus* beta-glucosidase (e.g., SEQ ID NO: 2 of WO2005/047499) and *Aspergillus fumigatus* xylanase (e.g., Xyl III in WO2006/078256). In another embodiment the cellulolytic enzyme composition comprises a *Trichoderma reesei* cellulolytic enzyme composition, further comprising *Penicillium emersonii* AA9 (GH61A) polypeptide having cellulolytic enhancing activity, in particular the one disclosed in WO2011/041397, *Aspergillus fumigatus* beta-glucosidase (e.g., SEQ ID NO: 2 of WO2005/047499), *Aspergillus fumigatus* xylanase (e.g., Xyl III in WO2006/078256), and CBH I from *Aspergillus fumigatus*, in particular Ce17A CBH1 disclosed as SEQ ID NO: 2 in WO2011/057140.

In another embodiment the cellulolytic enzyme composition is a *Trichoderma reesei* cellulolytic enzyme composition, further comprising *Penicillium emersonii* AA9 (GH61A) polypeptide having cellulolytic enhancing activity, in particular the one disclosed in WO2011/041397, *Aspergillus fumigatus* beta-glucosidase (e.g., SEQ ID NO: 2 of WO2005/047499), *Aspergillus fumigatus* xylanase (e.g., Xyl III in WO2006/078256), CBH I from *Aspergillus fumigatus*, in particular Ce17A CBH1 disclosed as SEQ ID NO: 2 in WO2011/057140, and CBH II derived from *Aspergillus fumigatus* in particular the one disclosed as SEQ ID NO: 4 in WO2013/028928.

In another embodiment the cellulolytic enzyme composition is a *Trichoderma reesei* cellulolytic enzyme composition, further comprising *Penicillium emersonii* AA9 (GH61A) polypeptide having cellulolytic enhancing activity, in particular the one disclosed in WO2011/041397,

*Aspergillus fumigatus* beta-glucosidase (e.g., SEQ ID NO: 2 of WO2005/047499) or variant thereof with one or more, in particular all, of the following substitutions: F100D, S283G, N456E, F512Y; *Aspergillus fumigatus* xylanase (e.g., Xyl III in WO2006/078256), CBH I from *Aspergillus fumigatus*, in particular Ce17A CBH I disclosed as SEQ ID NO: 2 in WO2011/057140, and CBH II derived from *Aspergillus fumigatus*, in particular the one disclosed in WO2013/028928.

In another embodiment the cellulolytic enzyme composition is a *Trichoderma reesei* cellulolytic enzyme composition comprising the CBH I (GENSEQP Accession No. AZY49536 (WO2012/103293); a CBH II (GENSEQP Accession No. AZY49446 (WO2012/103288); a beta-glucosidase variant (GENSEQP Accession No. AZU67153 (WO2012/44915)), in particular with one or more, in particular all, of the following substitutions: F100D, S283G, N456E, F512Y; and AA9 (GH61 polypeptide) (GENSEQP Accession No. BAL61510 (WO2013/028912)).

In another embodiment the cellulolytic enzyme composition is a *Trichoderma reesei* cellulolytic enzyme composition comprising a CBH I (GENSEQP Accession No. AZY49536 (WO2012/103293)); a CBH II (GENSEQP Accession No. AZY49446 (WO2012/103288); a GH10 xylanase (GENSEQP Accession No. BAK46118 (WO2013/019827)); and a beta-xylosidase (GENSEQP Accession No. AZI04896 (WO2011/057140)).

In another embodiment the cellulolytic enzyme composition is a *Trichoderma reesei* cellulolytic enzyme composition comprising a CBH I (GENSEQP Accession No. AZY49536 (WO2012/103293)); a CBH II (GENSEQP Accession No. AZY49446 (WO2012/103288)); and an AA9 (GH61 polypeptide; GENSEQP Accession No. BAL61510 (WO2013/028912)).

In another embodiment the cellulolytic enzyme composition is a *Trichoderma reesei* cellulolytic enzyme composition comprising a CBH I (GENSEQP Accession No. AZY49536 (WO2012/103293)); a CBH II (GENSEQP Accession No. AZY49446 (WO2012/103288)), an AA9 (GH61 polypeptide; GENSEQP Accession No. BAL61510 (WO2013/028912)), and a catalase (GENSEQP Accession No. BAC11005 (WO2012/130120)).

In an embodiment the cellulolytic enzyme composition is a *Trichoderma reesei* cellulolytic enzyme composition comprising a CBH I (GENSEQP Accession No. AZY49446 (WO2012/103288); a CBH II (GENSEQP Accession No. AZY49446 (WO2012/103288)), a beta-glucosidase variant (GENSEQP Accession No. AZU67153 (WO2012/44915)), with one or more, in particular all, of the following substitutions: F100D, S283G, N456E, F512Y; an AA9 (GH61 polypeptide; GENSEQP Accession No. BAL61510 (WO2013/028912)), a GH10 xylanase (GENSEQP Accession No. BAK46118 (WO2013/019827)), and a beta-xylosidase (GENSEQP Accession No. AZI04896 (WO2011/057140)).

In an embodiment the cellulolytic composition is a *Trichoderma reesei* cellulolytic enzyme preparation comprising an EG I (Swissprot Accession No. P07981), EG II (EMBL Accession No. M19373), CBH I (supra); CBH II (supra); beta-glucosidase variant (supra) with the following substitutions: F100D, S283G, N456E, F512Y; an AA9 (GH61 polypeptide; supra), GH10 xylanase (supra); and beta-xylosidase (supra).

All cellulolytic enzyme compositions disclosed in WO2013/028928 are also contemplated and hereby incorporated by reference.

The cellulolytic enzyme composition comprises or may further comprise one or more (several) proteins selected from the group consisting of a cellulase, a AA9 (i.e., GH61) polypeptide having cellulolytic enhancing activity, a hemicellulase, an expansin, an esterase, a laccase, a ligninolytic enzyme, a pectinase, a peroxidase, a protease, and a swollenin.

In one embodiment the cellulolytic enzyme composition is a commercial cellulolytic enzyme composition. Examples of commercial cellulolytic enzyme compositions suitable for use in a process of the invention include: CELLIC® CTec (Novozymes A/S), CELLIC® CTec2 (Novozymes A/S), CELLIC® CTec3 (Novozymes A/S), CELLUCLAST™ (Novozymes A/S), SPEZYME™ CP (Genencor Int.), ACCELLERASE™ 1000, ACCELLERASE 1500, ACCELLERASE™ TRIO (DuPont), FILTRASE® NL (DSM); METHAPLUS® S/L 100 (DSM), ROHAMENT™ 7069 W (Röhm GmbH), or ALTERNAFUEL® CMAX3™ (Dyadic International, Inc.). The cellulolytic enzyme composition may be added in an amount effective from about 0.001 to about 5.0 wt. % of solids, e.g., about 0.025 to about 4.0 wt. % of solids or about 0.005 to about 2.0 wt. % of solids.

Additional enzymes, and compositions thereof can be found in WO2011/153516 and WO2016/045569 (the contents of which are incorporated herein).

Additional polynucleotides encoding suitable cellulolytic enzymes may be obtained from microorganisms of any genus, including those readily available within the UniProtKB database (www.uniprot.org).

The cellulolytic enzyme coding sequences can also be used to design nucleic acid probes to identify and clone DNA encoding cellulolytic enzymes from strains of different genera or species, as described supra.

The polynucleotides encoding cellulolytic enzymes may also be identified and obtained from other sources including microorganisms isolated from nature (e.g., soil, composts, water, etc.) or DNA samples obtained directly from natural materials (e.g., soil, composts, water, etc,) as described supra.

Techniques used to isolate or clone polynucleotides encoding cellulolytic enzymes are described supra.

In one embodiment, the cellulolytic enzyme has a mature polypeptide sequence of at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to any cellulolytic enzyme described or referenced herein (e.g., any endoglucanase, cellobiohydrolase, or beta-glucosidase). In one aspect, the cellulolytic enzyme ha a mature polypeptide sequence that differs by no more than ten amino acids, e.g., by no more than five amino acids, by no more than four amino acids, by no more than three amino acids, by no more than two amino acids, or by one amino acid from any cellulolytic enzyme described or referenced herein. In one embodiment, the cellulolytic enzyme has a mature polypeptide sequence that comprises or consists of the amino acid sequence of any cellulolytic enzyme described or referenced herein, allelic variant, or a fragment thereof having cellulolytic enzyme activity. In one embodiment, the cellulolytic enzyme has an amino acid substitution, deletion, and/or insertion of one or more (e.g., two, several) amino acids. In some embodiments, the total number of amino acid substitutions, deletions and/or insertions is not more than 10, e.g., not more than 9, 8, 7, 6, 5, 4, 3, 2, or 1.

In some embodiments, the cellulolytic enzyme has at least 20%, e.g., at least 40%, at least 50%, at least 60%, at least 70%, at least 80%, at least 90%, at least 95%, at least 96%, at least 97%, at least 98%, at least 99%, or 100% of the cellulolytic enzyme activity of any cellulolytic enzyme described or referenced herein (e.g., any endoglucanase, cellobiohydrolase, or beta-glucosidase) under the same conditions.

In one embodiment, the cellulolytic enzyme coding sequence hybridizes under at least low stringency conditions, e.g., medium stringency conditions, medium-high stringency conditions, high stringency conditions, or very high stringency conditions with the full-length complementary strand of the coding sequence from any cellulolytic enzyme described or referenced herein (e.g., any endoglucanase, cellobiohydrolase, or beta-glucosidase). In one embodiment, the cellulolytic enzyme coding sequence has at least 65%, e.g., at least 70%, at least 75%, at least 80%, at least 85%, at least 85%, at least 90%, at least 91%, at least 92%, at least 93%, at least 94%, at least 95%, at least 96%, at least 97%, at least 98%, at least 99%, or 100% sequence identity with the coding sequence from any cellulolytic enzyme described or referenced herein.

In one embodiment, the polynucleotide encoding the cellulolytic enzyme comprises the coding sequence of any cellulolytic enzyme described or referenced herein (e.g., any endoglucanase, cellobiohydrolase, or beta-glucosidase). In one embodiment, the polynucleotide encoding the cellulolytic enzyme comprises a subsequence of the coding sequence from any cellulolytic enzyme described or referenced herein, wherein the subsequence encodes a polypeptide having cellulolytic enzyme activity. In one embodiment, the number of nucleotides residues in the subsequence is at least 75%, e.g., at least 80%, 85%, 90%, or 95% of the number of the referenced coding sequence.

The cellulolytic enzyme can also include fused polypeptides or cleavable fusion polypeptides, as described supra.

Xylose Metabolism

In one aspect, the fermenting organism (e.g., yeast cell) further comprises a heterologous polynucleotide encoding a xylose isomerase (XI). The xylose isomerase may be any xylose isomerase that is suitable for the host cells and the methods described herein, such as a naturally occurring xylose isomerase or a variant thereof that retains xylose isomerase activity. In one embodiment, the xylose isomerase is present in the cytosol of the host cells.

In some embodiments, the fermenting organism comprising a heterologous polynucleotide encoding a xylose isomerase has an increased level of xylose isomerase activity compared to the host cells without the heterologous polynucleotide encoding the xylose isomerase, when cultivated under the same conditions. In some embodiments, the fermenting organisms have an increased level of xylose isomerase activity of at least 5%, e.g., at least 10%, at least 15%, at least 20%, at least 25%, at least 50%, at least 100%, at least 150%, at least 200%, at least 300%, or at 500% compared to the host cells without the heterologous polynucleotide encoding the xylose isomerase, when cultivated under the same conditions.

Exemplary xylose isomerases that can be used with the host cells and methods of use described herein include, but are not limited to, XIs from the fungus *Piromyces* sp. (WO2003/062430) or other sources (Madhavan et al., 2009, *App/Microbiol Biotechnol.* 82(6), 1067-1078) have been expressed in *S. cerevisiae* host cells. Still other XIs suitable for expression in yeast have been described in US 2012/0184020 (an XI from Ruminococcus flavefaciens), WO2011/078262 (several XIs from *Reticulitermes speratus* and *Mastotermes darwiniensis*) and WO2012/009272 (constructs and fungal cells containing an XI from *Abiotrophia defectiva*). U.S. Pat. No. 8,586,336 describes a *S. cerevisiae* host cell expressing an XI obtained by bovine rumen fluid (shown herein as SEQ ID NO: 74).

Additional polynucleotides encoding suitable xylose isomerases may be obtained from microorganisms of any genus, including those readily available within the UniProtKB database (www.uniprot.org). In one embodiment, the xylose isomerases is a bacterial, a yeast, or a filamentous fungal xylose isomerase, e.g., obtained from any of the microorganisms described or referenced herein, as described supra.

The xylose isomerase coding sequences can also be used to design nucleic acid probes to identify and clone DNA encoding xylose isomerases from strains of different genera or species, as described supra.

The polynucleotides encoding xylose isomerases may also be identified and obtained from other sources including microorganisms isolated from nature (e.g., soil, composts, water, etc.) or DNA samples obtained directly from natural materials (e.g., soil, composts, water, etc,) as described supra.

Techniques used to isolate or clone polynucleotides encoding xylose isomerases are described supra.

In one embodiment, the xylose isomerase has a mature polypeptide sequence of having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to any xylose isomerase described or referenced herein (e.g., the xylose isomerase of SEQ ID NO: 74). In one aspect, the xylose isomerase has a mature polypeptide sequence that differs by no more than ten amino acids, e.g., by no more than five amino acids, by no more than four amino acids, by no more than three amino acids, by no more than two amino acids, or by one amino acid from any xylose isomerase described or referenced herein (e.g., the xylose isomerase of SEQ ID NO: 74). In one embodiment, the xylose isomerase has a mature polypeptide sequence that comprises or consists of the amino acid sequence of any xylose isomerase described or referenced herein (e.g., the xylose isomerase of SEQ ID NO: 74), allelic variant, or a fragment thereof having xylose isomerase activity. In one embodiment, the xylose isomerase has an amino acid substitution, deletion, and/or insertion of one or more (e.g., two, several) amino acids. In some embodiments, the total number of amino acid substitutions, deletions and/or insertions is not more than 10, e.g., not more than 9, 8, 7, 6, 5, 4, 3, 2, or 1.

In some embodiments, the xylose isomerase has at least 20%, e.g., at least 40%, at least 50%, at least 60%, at least 70%, at least 80%, at least 90%, at least 95%, at least 96%, at least 97%, at least 98%, at least 99%, or 100% of the xylose isomerase activity of any xylose isomerase described or referenced herein (e.g., the xylose isomerase of SEQ ID NO: 74) under the same conditions.

In one embodiment, the xylose isomerase coding sequence hybridizes under at least low stringency conditions, e.g., medium stringency conditions, medium-high stringency conditions, high stringency conditions, or very high stringency conditions with the full-length complementary strand of the coding sequence from any xylose isomerase described or referenced herein (e.g., the xylose isomerase of SEQ ID NO: 74). In one embodiment, the xylose isomerase coding sequence has at least 65%, e.g., at least 70%, at least 75%, at least 80%, at least 85%, at least 85%, at least 90%, at least 91%, at least 92%, at least 93%, at least 94%, at least 95%, at least 96%, at least 97%, at least 98%, at least 99%, or 100% sequence identity with the coding sequence from any xylose isomerase described or referenced herein (e.g., the xylose isomerase of SEQ ID NO: 74).

In one embodiment, the heterologous polynucleotide encoding the xylose isomerase comprises the coding sequence of any xylose isomerase described or referenced herein (e.g., the xylose isomerase of SEQ ID NO: 74). In one embodiment, the heterologous polynucleotide encoding the xylose isomerase comprises a subsequence of the coding sequence from any xylose isomerase described or referenced herein, wherein the subsequence encodes a polypeptide having xylose isomerase activity. In one embodiment, the number of nucleotides residues in the subsequence is at least 75%, e.g., at least 80%, 85%, 90%, or 95% of the number of the referenced coding sequence.

The xylose isomerases can also include fused polypeptides or cleavable fusion polypeptides, as described supra.

In one aspect, the fermenting organism (e.g., yeast cell) further comprises a heterologous polynucleotide encoding a xylulokinase (XK). A xylulokinase, as used herein, provides enzymatic activity for converting D-xylulose to xylulose 5-phosphate. The xylulokinase may be any xylulokinase that is suitable for the host cells and the methods described herein, such as a naturally occurring xylulokinase or a variant thereof that retains xylulokinase activity. In one embodiment, the xylulokinase is present in the cytosol of the host cells.

In some embodiments, the fermenting organisms comprising a heterologous polynucleotide encoding a xylulokinase have an increased level of xylulokinase activity compared to the host cells without the heterologous polynucleotide encoding the xylulokinase, when cultivated under the same conditions. In some embodiments, the host cells have an increased level of xylose isomerase activity of at least 5%, e.g., at least 10%, at least 15%, at least 20%, at least 25%, at least 50%, at least 100%, at least 150%, at least 200%, at least 300%, or at 500% compared to the host cells without the heterologous polynucleotide encoding the xylulokinase, when cultivated under the same conditions.

Exemplary xylulokinases that can be used with the fermenting organisms and methods of use described herein include, but are not limited to, the *Saccharomyces cerevisiae* xylulokinase of SEQ ID NO: 75. Additional polynucleotides encoding suitable xylulokinases may be obtained from microorganisms of any genus, including those readily available within the UniProtKB database (www.uniprot.org). In one embodiment, the xylulokinases is a bacterial, a yeast, or a filamentous fungal xylulokinase, e.g., obtained from any of the microorganisms described or referenced herein, as described supra.

The xylulokinase coding sequences can also be used to design nucleic acid probes to identify and clone DNA encoding xylulokinases from strains of different genera or species, as described supra.

The polynucleotides encoding xylulokinases may also be identified and obtained from other sources including microorganisms isolated from nature (e.g., soil, composts, water, etc.) or DNA samples obtained directly from natural materials (e.g., soil, composts, water, etc,) as described supra.

Techniques used to isolate or clone polynucleotides encoding xylulokinases are described supra.

In one embodiment, the xylulokinase has a mature polypeptide sequence of at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to any xylulokinase described or referenced herein (e.g., the *Saccharomyces cerevisiae* xylulokinase of SEQ ID NO: 75). In one embodiment, the xylulokinase has a mature polypeptide sequence that differs by no more than ten amino acids, e.g., by no more than five amino acids, by no more than four amino acids, by no more than three amino acids, by no more than two amino acids, or by one amino acid from any xylulokinase described or referenced herein (e.g., the *Saccharomyces cerevisiae* xylulokinase of SEQ ID NO: 75). In one embodiment, the xylulokinase has a mature polypeptide sequence that comprises or consists of the amino acid sequence of any xylulokinase described or referenced herein (e.g., the *Saccharomyces cerevisiae* xylulokinase of SEQ ID NO: 75), allelic variant, or a fragment thereof having xylulokinase activity. In one embodiment, the xylulokinase has an amino acid substitution, deletion, and/or insertion of one or more (e.g., two, several) amino acids. In some embodiments, the total number of amino acid substitutions, deletions and/or insertions is not more than 10, e.g., not more than 9, 8, 7, 6, 5, 4, 3, 2, or 1.

In some embodiments, the xylulokinase has at least 20%, e.g., at least 40%, at least 50%, at least 60%, at least 70%, at least 80%, at least 90%, at least 95%, at least 96%, at least 97%, at least 98%, at least 99%, or 100% of the xylulokinase activity of any xylulokinase described or referenced herein (e.g., the *Saccharomyces cerevisiae* xylulokinase of SEQ ID NO: 75) under the same conditions.

In one embodiment, the xylulokinase coding sequence hybridizes under at least low stringency conditions, e.g., medium stringency conditions, medium-high stringency conditions, high stringency conditions, or very high stringency conditions with the full-length complementary strand of the coding sequence from any xylulokinase described or referenced herein (e.g., the *Saccharomyces cerevisiae* xylulokinase of SEQ ID NO: 75). In one embodiment, the xylulokinase coding sequence has at least 65%, e.g., at least 70%, at least 75%, at least 80%, at least 85%, at least 85%, at least 90%, at least 91%, at least 92%, at least 93%, at least 94%, at least 95%, at least 96%, at least 97%, at least 98%, at least 99%, or 100% sequence identity with the coding sequence from any xylulokinase described or referenced herein (e.g., the *Saccharomyces cerevisiae* xylulokinase of SEQ ID NO: 75).

In one embodiment, the heterologous polynucleotide encoding the xylulokinase comprises the coding sequence of any xylulokinase described or referenced herein (e.g., the *Saccharomyces cerevisiae* xylulokinase of SEQ ID NO: 75). In one embodiment, the heterologous polynucleotide encoding the xylulokinase comprises a subsequence of the coding sequence from any xylulokinase described or referenced herein, wherein the subsequence encodes a polypeptide having xylulokinase activity. In one embodiment, the number of nucleotides residues in the subsequence is at least 75%, e.g., at least 80%, 85%, 90%, or 95% of the number of the referenced coding sequence.

The xylulokinases can also include fused polypeptides or cleavable fusion polypeptides, as described supra.

In one aspect, the fermenting organism (e.g., yeast cell) further comprises a heterologous polynucleotide encoding a ribulose 5 phosphate 3-epimerase (RPE1). A ribulose 5 phosphate 3-epimerase, as used herein, provides enzymatic activity for converting L-ribulose 5-phosphate to L-xylulose 5-phosphate (EC 5.1.3.22). The RPE1 may be any RPE1 that is suitable for the host cells and the methods described herein, such as a naturally occurring RPE1 or a variant thereof that retains RPE1 activity. In one embodiment, the RPE1 is present in the cytosol of the host cells.

In one embodiment, the recombinant cell comprises a heterologous polynucleotide encoding a ribulose 5 phosphate 3-epimerase (RPE1), wherein the RPE1 is *Saccharomyces cerevisiae* RPE1, or an RPE1 having at least 60%, e.g., at least 65%, 70%, 75%, 80%, 85%, 90%, 95%, 97%, 98%, 99%, or 100% sequence identity to a *Saccharomyces cerevisiae* RPE1.

In one aspect, the fermenting organism (e.g., yeast cell) further comprises a heterologous polynucleotide encoding a ribulose 5 phosphate isomerase (RKI1). A ribulose 5 phosphate isomerase, as used herein, provides enzymatic activity for converting ribose-5-phophate to ribulose 5-phosphate. The RKI1 may be any RKI1 that is suitable for the host cells and the methods described herein, such as a naturally occurring RKI1 or a variant thereof that retains RKI1 activity. In one embodiment, the RKI1 is present in the cytosol of the host cells.

In one embodiment, the fermenting organism comprises a heterologous polynucleotide encoding a ribulose 5 phosphate isomerase (RKI1), wherein the RKI1 is a *Saccharomyces cerevisiae* RKI1, or an RKI1 having a mature polypeptide sequence of at least 60%, e.g., at least 65%, 70%, 75%, 80%, 85%, 90%, 95%, 97%, 98%, 99%, or 100% sequence identity to a *Saccharomyces cerevisiae* RKI1.

In one aspect, the fermenting organism (e.g., yeast cell) further comprises a heterologous polynucleotide encoding a transketolase (TKL1). The TKL1 may be any TKL1 that is suitable for the host cells and the methods described herein, such as a naturally occurring TKL1 or a variant thereof that retains TKL1 activity. In one embodiment, the TKL1 is present in the cytosol of the host cells.

In one embodiment, the fermenting organism comprises a heterologous polynucleotide encoding a transketolase (TKL1), wherein the TKL1 is a *Saccharomyces cerevisiae* TKL1, or a TKL1 having a mature polypeptide sequence of at least 60%, e.g., at least 65%, 70%, 75%, 80%, 85%, 90%, 95%, 97%, 98%, 99%, or 100% sequence identity to a *Saccharomyces cerevisiae* TKL1.

In one aspect, the fermenting organism (e.g., yeast cell) further comprises a heterologous polynucleotide encoding a transaldolase (TAL1). The TAL1 may be any TAL1 that is suitable for the host cells and the methods described herein, such as a naturally occurring TAL1 or a variant thereof that retains TAL1 activity. In one embodiment, the TAL1 is present in the cytosol of the host cells.

In one embodiment, the fermenting organism comprises a heterologous polynucleotide encoding a transketolase (TAL1), wherein the TAL1 is a *Saccharomyces cerevisiae* TAL1, or a TAL1 having a mature polypeptide sequence of at least 60%, e.g., at least 65%, 70%, 75%, 80%, 85%, 90%, 95%, 97%, 98%, 99%, or 100% sequence identity to a *Saccharomyces cerevisiae* TAL1.

Fermentation Products

A fermentation product can be any substance derived from the fermentation. The fermentation product can be, without limitation, an alcohol (e.g., arabinitol, n-butanol, isobutanol, ethanol, glycerol, methanol, ethylene glycol, 1,3-propanediol [propylene glycol], butanediol, glycerin, sorbitol, and xylitol); an alkane (e.g., pentane, hexane, heptane, octane, nonane, decane, undecane, and dodecane), a cycloalkane (e.g., cyclopentane, cyclohexane, cycloheptane, and cyclooctane), an alkene (e.g., pentene, hexene, heptene, and octene); an amino acid (e.g., aspartic acid, glutamic acid, glycine, lysine, serine, and threonine); a gas (e.g., methane, hydrogen ($H_2$), carbon dioxide ($CO_2$), and carbon monoxide (CO)); isoprene; a ketone (e.g., acetone); an organic acid (e.g., acetic acid, acetonic acid, adipic acid, ascorbic acid, citric acid, 2,5-diketo-D-gluconic acid, formic acid, fumaric acid, glucaric acid, gluconic acid, glucuronic acid, glutaric acid, 3-hydroxypropionic acid, itaconic acid, lactic acid, malic acid, malonic acid, oxalic acid, oxaloacetic acid, propionic acid, succinic acid, and xylonic acid); and polyketide.

In one aspect, the fermentation product is an alcohol. The term "alcohol" encompasses a substance that contains one or more hydroxyl moieties. The alcohol can be, but is not limited to, n-butanol, isobutanol, ethanol, methanol, arabinitol, butanediol, ethylene glycol, glycerin, glycerol, 1,3-propanediol, sorbitol, xylitol. See, for example, Gong et al., 1999, Ethanol production from renewable resources, in *Advances in Biochemical Engineering/Biotechnology*, Scheper, T., ed., Springer-Verlag Berlin Heidelberg, Germany, 65: 207-241; Silveira and Jonas, 2002, *Appl. Microbiol. Biotechnol.* 59: 400-408; Nigam and Singh, 1995, *Process Biochemistry* 30(2): 117-124; Ezeji et al., 2003, *World Journal of Microbiology and Biotechnology* 19(6): 595-603. In one embodiment, the fermentation product is ethanol.

In another aspect, the fermentation product is an alkane. The alkane may be an unbranched or a branched alkane. The alkane can be, but is not limited to, pentane, hexane, heptane, octane, nonane, decane, undecane, or dodecane.

In another aspect, the fermentation product is a cycloalkane. The cycloalkane can be, but is not limited to, cyclopentane, cyclohexane, cycloheptane, or cyclooctane.

In another aspect, the fermentation product is an alkene. The alkene may be an unbranched or a branched alkene. The alkene can be, but is not limited to, pentene, hexene, heptene, or octene.

In another aspect, the fermentation product is an amino acid. The organic acid can be, but is not limited to, aspartic acid, glutamic acid, glycine, lysine, serine, or threonine. See, for example, Richard and Margaritis, 2004, *Biotechnology and Bioengineering* 87(4): 501-515.

In another aspect, the fermentation product is a gas. The gas can be, but is not limited to, methane, $H_2$, $CO_2$, or CO. See, for example, Kataoka et al., 1997, *Water Science and Technology* 36(6-7): 41-47; and Gunaseelan, 1997, *Biomass and Bioenergy* 13(1-2): 83-114.

In another aspect, the fermentation product is isoprene.

In another aspect, the fermentation product is a ketone. The term "ketone" encompasses a substance that contains one or more ketone moieties. The ketone can be, but is not limited to, acetone.

In another aspect, the fermentation product is an organic acid. The organic acid can be, but is not limited to, acetic acid, acetonic acid, adipic acid, ascorbic acid, citric acid, 2,5-diketo-D-gluconic acid, formic acid, fumaric acid, glucaric acid, gluconic acid, glucuronic acid, glutaric acid, 3-hydroxypropionic acid, itaconic acid, lactic acid, malic acid, malonic acid, oxalic acid, propionic acid, succinic acid, or xylonic acid. See, for example, Chen and Lee, 1997, *Appl. Biochem. Biotechnol.* 63-65: 435-448.

In another aspect, the fermentation product is polyketide.

Recovery

The fermentation product, e.g., ethanol, can optionally be recovered from the fermentation medium using any method known in the art including, but not limited to, chromatography, electrophoretic procedures, differential solubility, distillation, or extraction. For example, alcohol is separated from the fermented cellulosic material and purified by conventional methods of distillation. Ethanol with a purity of up to about 96 vol. % can be obtained, which can be used as, for example, fuel ethanol, drinking ethanol, i.e., potable neutral spirits, or industrial ethanol.

In some aspects of the methods, the fermentation product after being recovered is substantially pure. With respect to the methods herein, "substantially pure" intends a recovered preparation that contains no more than 15% impurity, wherein impurity intends compounds other than the fermentation product (e.g., ethanol). In one variation, a substantially pure preparation is provided wherein the preparation contains no more than 25% impurity, or no more than 20% impurity, or no more than 10% impurity, or no more than 5% impurity, or no more than 3% impurity, or no more than 1% impurity, or no more than 0.5% impurity.

Suitable assays to test for the production of ethanol and contaminants, and sugar consumption can be performed using methods known in the art. For example, ethanol product, as well as other organic compounds, can be analyzed by methods such as HPLC (High Performance Liquid Chromatography), GC-MS (Gas Chromatography Mass Spectroscopy) and LC-MS (Liquid Chromatography-Mass Spectroscopy) or other suitable analytical methods using routine procedures well known in the art. The release of ethanol in the fermentation broth can also be tested with the culture supernatant. Byproducts and residual sugar in the fermentation medium (e.g., glucose or xylose) can be quantified by HPLC using, for example, a refractive index detector for glucose and alcohols, and a UV detector for organic acids (Lin et al., *Biotechnol. Bioeng.* 90:775-779 (2005)), or using other suitable assay and detection methods well known in the art.

The invention may further be described in the following numbered paragraphs:

Paragraph [1]. A method of producing a fermentation product from a starch-containing or cellulosic-containing material comprising:
(a) saccharifying the starch-containing or cellulosic-containing material; and
(b) fermenting the saccharified material of step (a) with a fermenting organism;
wherein the fermenting organism comprises a heterologous polynucleotide encoding an alpha-amylase or a heterologous polynucleotide encoding a trehalase.

Paragraph [2]. The method of paragraph [1], wherein the alpha-amylase has a mature polypeptide sequence with 60%, e.g., at least 65%, 70%, 75%, 80%, 85%, 90%, 95%, 97%, 98%, 99%, or 100% sequence identity, to the amino acid sequence of any one of SEQ ID NOs: 76-101, 121-174 and 231.

Paragraph [3]. The method of paragraph [1] or [2], wherein the heterologous polynucleotide encodes an alpha-amylase having a mature polypeptide sequence that differs by no more than ten amino acids, e.g., by no more than five amino acids, by no more than four amino acids, by no more than three amino acids, by no more than two amino acids, or by one amino acid from the amino acid sequence of any one of SEQ ID NOs: 76-101, 121-174 and 231.

Paragraph [4]. The method of any one of paragraphs [1]-[3], wherein the heterologous polynucleotide encodes an alpha-amylase having a mature polypeptide sequence comprising or consisting of the amino acid sequence of any one of SEQ ID NOs: SEQ ID NOs: 76-101, 121-174 and 231.

Paragraph [5]. The method of any one of paragraphs [1]-[4], wherein the trehalase has mature polypeptide sequence with 60%, e.g., at least 65%, 70%, 75%, 80%, 85%, 90%, 95%, 97%, 98%, 99%, or 100% sequence identity, to the amino acid sequence of any one of SEQ ID NOs: 175-226.

Paragraph [6]. The method any one of paragraphs [1]-[5], wherein the heterologous polynucleotide encodes a trehalase having a mature polypeptide sequence that differs by no more than ten amino acids, e.g., by no more than five amino acids, by no more than four amino acids, by no more than three amino acids, by no more than two amino acids, or by one amino acid from the amino acid sequence of any one of SEQ ID NOs: 175-226.

Paragraph [7]. The method of any one of paragraphs [1]-[6], wherein the heterologous polynucleotide encodes a trehalase having a mature polypeptide sequence comprising or consisting of the amino acid sequence of any one of SEQ ID NOs: SEQ ID NOs: 175-226.

Paragraph [8]. The method of any one of paragraphs [1]-[7], wherein saccharification of step (a) occurs on a starch-containing material, and wherein the starch-containing material is either gelatinized or ungelatinized starch.

Paragraph [9]. The method of paragraph [8], comprising liquefying the starch-containing material by contacting the material with an alpha-amylase prior to saccharification.

Paragraph [10]. The method of paragraph [9], wherein liquefying the starch-containing material and/or saccharifying the starch-containing material is conducted in presence of exogenously added protease.

Paragraph [11]. The method of any one of paragraphs [1]-[10], wherein fermentation is performed under reduced nitrogen conditions (e.g., less than 1000 ppm urea or ammonium hydroxide, such as less than 750 ppm, less than 500 ppm, less than 400 ppm, less than 300 ppm, less than 250 ppm, less than 200 ppm, less than 150 ppm, less than 100 ppm, less than 75 ppm, less than 50 ppm, less than 25 ppm, or less than 10 ppm).

Paragraph [12]. The method of any one of paragraphs [1]-[11], wherein fermentation and saccharification are performed simultaneously in a simultaneous saccharification and fermentation (SSF).

Paragraph [13]. The method of any one of paragraphs [1]-[11], wherein fermentation and saccharification are performed sequentially (SHF).

Paragraph [14]. The method of any one of paragraphs paragraph [1]-[13], comprising recovering the fermentation product from the from the fermentation.

Paragraph [15]. The method of paragraph [14], wherein recovering the fermentation product from the from the fermentation comprises distillation.

Paragraph [16]. The method of any one of paragraphs [1]-[15], wherein the fermentation product is ethanol.

Paragraph [17]. The method of any one of paragraphs [1]-[16], wherein the fermenting organism comprises a heterologous polynucleotide encoding a glucoamylase.

Paragraph [18]. The method of paragraph [17], wherein the glucoamylase has a mature polypeptide sequence with 60%, e.g., at least 65%, 70%, 75%, 80%, 85%, 90%, 95%, 97%, 98%, 99%, or 100% sequence identity, to the amino acid sequence of a *Pycnoporus glycoamylase* (e.g., a *Pycnoporus sanguineus* glucoamylase of SEQ ID NO: 229), a *Gloeophyllum* glucoamylase (e.g. a *Gloeophyllum sepiarium* of SEQ ID NO: 8), or a glucoamylase of any one of SEQ ID NOs: 102-113 (e.g., a *Saccharomycopsis fibuligera* glucoamylase of SEQ ID NO: 103 or 104, or a *Trichoderma reesei* glucoamylase of SEQ ID NO: 230).

Paragraph [19]. The method of any one of paragraphs [1]-[18], wherein the fermenting organism comprises a heterologous polynucleotide encoding a protease.

Paragraph [20]. The method of paragraph [19], wherein the protease has a mature polypeptide sequence of at least 60%, e.g., at least 65%, 70%, 75%, 80%, 85%, 90%, 95%, 97%, 98%, 99%, or 100% sequence identity to the amino acid sequence of any one of SEQ ID NOs: 9-73 (e.g., any one of SEQ ID NOs: 9, 14, 16, 21, 22, 33, 41, 45, 61, 62, 66, 67, and 69; such as any one of SEQ NOs: 9, 14, 16, and 69).

Paragraph [21]. The method of any one of paragraphs [1]-[20], wherein saccharification of step (a) occurs on a cellulosic-containing material, and wherein the cellulosic-containing material is pretreated.

Paragraph [22]. The method of paragraph [21], wherein the pretreatment is a dilute acid pretreatment.

Paragraph [23]. The method of any one of paragraphs [1]-[20], wherein saccharification occurs on a cellulosic-containing material, and wherein the enzyme composition comprises one or more enzymes selected from a cellulase, an AA9 polypeptide, a hemicellulase, a CIP, an esterase, an expansin, a ligninolytic enzyme, an oxidoreductase, a pectinase, a protease, and a swollenin.

Paragraph [24]. The method of paragraph [23], wherein the cellulase is one or more enzymes selected from an endoglucanase, a cellobiohydrolase, and a beta-glucosidase.

Paragraph [25]. The method of paragraph [23] or [24], wherein the hemicellulase is one or more enzymes selected a xylanase, an acetylxylan esterase, a feruloyl esterase, an arabinofuranosidase, a xylosidase, and a glucuronidase.

Paragraph [26]. The method of any one of paragraphs [1]-[25], wherein the fermenting organism is a *Saccharomyces, Rhodotorula, Schizosaccharomyces, Kluyveromyces, Pichia, Hansenula, Rhodosporidium, Candida, Yarrowia, Lipomyces, Cryptococcus,* or *Dekkera* sp. cell.

Paragraph [27]. The method of any one of paragraphs [1]-[26], wherein the fermenting organism is a *Saccharomyces cerevisiae* cell.

Paragraph [28]. A recombinant yeast cell comprising a heterologous polynucleotide encoding an alpha-amylase or a heterologous polynucleotide encoding a trehalase.

Paragraph [29]. The recombinant yeast cell of paragraph [28], wherein the alpha-amylase has a mature polypeptide sequence with 60%, e.g., at least 65%, 70%, 75%, 80%, 85%, 90%, 95%, 97%, 98%, 99%, or 100% sequence identity, to the amino acid sequence of any one of SEQ ID NOs: 76-101, 121-174 and 231.

Paragraph [30]. The recombinant yeast cell of paragraph [28] or [29], wherein the heterologous polynucleotide encodes an alpha-amylase having a mature polypeptide sequence that differs by no more than ten amino acids, e.g., by no more than five amino acids, by no more than four amino acids, by no more than three amino acids, by no more than two amino acids, or by one amino acid from the amino acid sequence of any one of SEQ ID NOs: 76-101, 121-174 and 231.

Paragraph [31]. The recombinant yeast cell of any one of paragraphs [28]-[30], wherein the heterologous polynucleotide encodes an alpha-amylase having a mature polypeptide sequence comprising or consisting of the amino acid sequence of any one of SEQ ID NOs: SEQ ID NOs: 76-101, 121-174 and 231.

Paragraph [32]. The recombinant yeast cell of any one of paragraphs [28]-[31], wherein the trehalase has mature polypeptide sequence with 60%, e.g., at least 65%, 70%, 75%, 80%, 85%, 90%, 95%, 97%, 98%, 99%, or 100% sequence identity, to the amino acid sequence of any one of SEQ ID NOs: 175-226.

Paragraph [33]. The recombinant yeast cell of any one of paragraphs [28]-[32], wherein the heterologous polynucleotide encodes a trehalase having a mature polypeptide sequence that differs by no more than ten amino acids, e.g., by no more than five amino acids, by no more than four amino acids, by no more than three amino acids, by no more than two amino acids, or by one amino acid from the amino acid sequence of any one of SEQ ID NOs: 175-226.

Paragraph [34]. The recombinant yeast cell of any one of paragraphs [28]-[33], wherein the heterologous polynucleotide encodes a trehalase having a mature polypeptide sequence comprising or consisting of the amino acid sequence of any one of SEQ ID NOs: SEQ ID NOs: 175-226

Paragraph [35]. The recombinant yeast cell of any one of paragraphs [28]-[34], wherein the fermenting organism comprises a heterologous polynucleotide encoding a glucoamylase.

Paragraph [36]. The recombinant yeast cell of paragraph [35], wherein the glucoamylase has a mature polypeptide sequence with 60%, e.g., at least 65%, 70%, 75%, 80%, 85%, 90%, 95%, 97%, 98%, 99%, or 100% sequence identity, to the amino acid sequence of a *Pycnoporus glycoamylase* (e.g., a *Pycnoporus sanguineus* glucoamylase of SEQ ID NO: 229), a *Gloeophyllum* glucoamylase (e.g. a *Gloeophyllum sepiarium* of SEQ ID NO: 8), or a glucoamylase of any one of SEQ ID NOs: 102-113 (e.g., a *Saccharomycopsis fibuligera* glucoamylase of SEQ ID NO: 103 or 104, or a *Trichoderma reesei* glucoamylase of SEQ ID NO: 230).

Paragraph [37]. The recombinant yeast cell of any one of paragraphs [28]-[36], wherein the fermenting organism comprises a heterologous polynucleotide encoding a protease.

Paragraph [38]. The recombinant yeast cell of paragraph [37], wherein the protease has a mature polypeptide sequence of at least 60%, e.g., at least 65%, 70%, 75%, 80%, 85%, 90%, 95%, 97%, 98%, 99%, or 100% sequence identity to the amino acid sequence of any one of SEQ ID NOs: 9-73 (e.g., any one of SEQ ID NOs: 9, 14, 16, 21, 22, 33, 41, 45, 61, 62, 66, 67, and 69; such as any one of SEQ NOs: 9, 14, 16, and 69).

Paragraph [39]. The recombinant yeast of any one of paragraphs [28]-[38], wherein the cell is a *Saccharomyces, Rhodotorula, Schizosaccharomyces, Kluyveromyces, Pichia, Hansenula, Rhodosporidium, Candida, Yarrowia, Lipomyces, Cryptococcus,* or *Dekkera* sp. cell.

Paragraph [40]. The recombinant yeast of paragraph [39], wherein the cell is a *Saccharomyces cerevisiae* cell.

The invention described and claimed herein is not to be limited in scope by the specific aspects herein disclosed, since these aspects are intended as illustrations of several aspects of the invention. Any equivalent aspects are intended to be within the scope of this invention. Indeed, various modifications of the invention in addition to those shown and described herein will become apparent to those skilled in the art from the foregoing description. Such modifications are also intended to fall within the scope of the appended claims. In the case of conflict, the present disclosure including definitions will control. All references are specifically incorporated by reference for that which is described.

The following examples are offered to illustrate certain aspects of the present invention, but not in any way intended to limit the scope of the invention as claimed.

EXAMPLES

Materials and Methods

Chemicals used as buffers and substrates were commercial products of at least reagent grade.

ETHANOL RED® ("ER"): *Saccharomyces cerevisiae* yeast available from Fermentis/Lesaffre, USA.

YPD+clonNAT plates were composed of 10 g of yeast extract, 20 g of peptone, 20 g bacto agar, and deionized water to 960 ml, followed by autoclave treatment. 40 ml sterile 50% glucose and 1 ml clonNAT stock solution was added, followed by mixing and pouring.

clonNAT stock solution was composed of 2 g nourseothricin sulfate and deionized water to 20 ml.

Example 1: Construction of Yeast Strains Expressing a Heterologous Alpha-Amylase This example describes the construction of yeast cells containing a heterologous alpha-amylase under control of an *S. cerevisiae* TDH3 promoter (SEQ ID NO: 1) or ADH1 promoter (SEQ ID NO: 5). Three pieces of DNA containing the promoter, gene and terminator were designed to allow for homologous recombination between the 3 DNA fragments and into the X-3 locus of the yeast yMHCT484 (PCT/US2018/035596). The resulting strain has one promoter containing fragment (left), one gene containing fragment (middle) and one ENO2 terminator (SEQ ID NO: 228) fragment (right) integrated into the *S. cerevisiae* genome at the X-3 locus.

Construction of the Promoter Containing Fragments (Left Fragments)

Synthetic linear uncloned DNA containing 300 bp homology to the X-3 site, *S. cerevisiae* promoter ADH1 (SEQ ID NO: 5) or THD3 (SEQ ID NO: 1) and *S. cerevisiae* EXG1 signal sequence (SEQ ID NO: 227) were synthesized by Thermo Fisher Scientific. The 2 linear DNAs were designated 17ABCK4P and 17ABCK3P for each promoter listed above, respectively. To generate additional linear DNA for transformation into yeast, the DNA containing the left cassette was PCR amplified from 17ABCK4P and 17ABCK3P.

Construction of the Alpha-Amylase-Containing Fragments (Middle Fragments)

Synthetic linear uncloned DNA containing *S. cerevisiae* EXG1 signal peptide coding sequence (encoding the signal of SEQ ID NO: 227), a codon-optimized alpha-amylase gene and 50 bp of ENO2 terminator (SEQ ID NO: 228), were synthesized by Thermo Fisher Scientific.

To generate linear DNA for transformation into yeast, the DNA containing the alpha-amylase cassette was PCR amplified from the synthetic DNA with primers 1222985 (5'-ATGAT GAAAA AATAA GCAGA AAAGA CTAAT AATTC TTAGT TAAAA GC-3'; SEQ ID NO: 235) and 1222984 (5'-ATGCT TTCGC TTAAA ACGTT ACTGT G-3'; SEQ ID NO: 236). Fifty pmoles each of forward and reverse primer was used in a PR reaction containing 5 ng of plasmid DNA as template, 0.1 mM each dATP, dGTP, dCTP, dTTP, X Phusion HF Buffer (Thermo Fisher Scientific), and 2 units Phusion Hot Start DNA polymerase in a final volume of 50 μL. The PR was performed in a T100™ Thermal Cycler (Bio-Rad Laboratories, Inc.) programmed for one cycle at 98° C. for 1 minute followed by 32 cycles each at 98° C. for 10 seconds, 55° C. for 30 seconds, and 72° C. for 2 minutes with a final extension at 72° C. for 10 minutes. Following thermocycling, the PCR reaction products gel isolated and cleaned up using the NucleoSpin Gel and PCR clean-up kit (Machery-Nagel). The resulting linear DNAs were designated as indicated in Table 4.

TABLE 4

Alpha-amylase DNA product names and associated enzyme

| Product Number | DNA format | Signal peptide | Donor Organism (catalytic domain) | SEQ ID NO: (mature polypeptide) | Terminator Fragment |
|---|---|---|---|---|---|
| 17ABDQYP | linear | EXG1 | *Rhizomucor pusillus* | 121 | ENO2 |
| 17ABDQXP | linear | EXG1 | *Bacillus licheniformis* | 122 | ENO2 |
| 17ABDQWP | linear | EXG1 | *Aspergillus niger* | 123 | ENO2 |
| 17ABDQVP | linear | EXG1 | *Aspergillus tamarii* | 124 | ENO2 |
| 17ABDQUP | linear | EXG1 | *Acidomyces richmondensis* | 125 | ENO2 |
| 17ABDQTP | linear | EXG1 | *Aspergillus bombycis* | 126 | ENO2 |
| 17ABDQSP | linear | EXG1 | *Alternaria* sp | 127 | ENO2 |
| 17ABDQRP | linear | EXG1 | *Rhizopus microsporus* | 128 | ENO2 |
| 17ABDQQP | linear | EXG1 | *Syncephalastrum racemosum* | 129 | ENO2 |
| 17ABDQPP | linear | EXG1 | *Rhizomucor pusillus* | 130 | ENO2 |
| 17ABDQOP | linear | EXG1 | *Dichotomocladium hesseltinei* | 131 | ENO2 |
| 17ABDQNP | linear | EXG1 | *Lichtheimia ramosa* | 132 | ENO2 |
| 17ABDQMP | linear | EXG1 | *Penicillium aethiopicum* | 133 | ENO2 |
| 17ABDQLP | linear | EXG1 | *Subulispora* sp | 134 | ENO2 |
| 17ABDQKP | linear | EXG1 | *Trichoderma paraviridescens* | 135 | ENO2 |
| 17ABDQJP | linear | EXG1 | *Byssoascus striatosporus* | 136 | ENO2 |
| 17ABDQIP | linear | EXG1 | *Aspergillus brasiliensis* | 137 | ENO2 |
| 17ABDQHP | linear | EXG1 | *Penicillium subspinulosum* | 138 | ENO2 |
| 17ABDQGP | linear | EXG1 | *Penicillium antarcticum* | 139 | ENO2 |
| 17ABDQFP | linear | EXG1 | *Penicillium coprophilum* | 140 | ENO2 |

TABLE 4-continued

Alpha-amylase DNA product names and associated enzyme

| Product Number | DNA format | Signal peptide | Donor Organism (catalytic domain) | SEQ ID NO: (mature polypeptide) | Terminator Fragment |
|---|---|---|---|---|---|
| 17ABDQEP | linear | EXG1 | Penicillium olsonii | 141 | ENO2 |
| 17ABDQDP | linear | EXG1 | Penicillium vasconiae | 142 | ENO2 |
| 17ABDQCP | linear | EXG1 | Penicillium sp | 143 | ENO2 |
| 17ABDQBP | linear | EXG1 | Heterocephalum aurantiacum | 144 | ENO2 |
| 17ABDQAP | linear | EXG1 | Neosartorya massa | 145 | ENO2 |
| 17ABDP7P | linear | EXG1 | Penicillium janthinellum | 146 | ENO2 |
| 17ABDP6P | linear | EXG1 | Aspergillus brasiliensis | 147 | ENO2 |
| 17ABDP5P | linear | EXG1 | Aspergillus westerdijkiae | 148 | ENO2 |
| 17ABDP4P | linear | EXG1 | Hamigera avellanea | 149 | ENO2 |
| 17ABDP3P | linear | EXG1 | Hamigera avellanea | 150 | ENO2 |
| 17ABDP2P | linear | EXG1 | Meripilus giganteus | 151 | ENO2 |
| 17ABDPZP | linear | EXG1 | Cerrena unicolor | 152 | ENO2 |
| 17ABDPYP | linear | EXG1 | Physalacria cryptomeriae | 153 | ENO2 |
| 17ABDPXP | linear | EXG1 | Lenzites betulinus | 154 | ENO2 |
| 17ABDPWP | linear | EXG1 | Trametes ljubarskyi | 155 | ENO2 |
| 17ABDPVP | linear | EXG1 | Bacillus subtilis | 156 | ENO2 |
| 17ABDPUP | linear | EXG1 | Bacillus subtilis subsp. subtilis | 157 | ENO2 |
| 17ABDPTP | linear | EXG1 | Schwanniomyces occidentalis | 158 | ENO2 |
| 17ABDPSP | linear | EXG1 | Rhizomucor pusillus | 159 | ENO2 |
| 17ABDPRP | linear | EXG1 | Aspergillus niger | 160 | ENO2 |
| 17ABDPQP | linear | EXG1 | Bacillus stearothermophilus | 161 | ENO2 |
| 17ABDPPP | linear | EXG1 | Bacillus halmapalus | 162 | ENO2 |
| 17ABDPOP | linear | EXG1 | Aspergillus oryzae | 163 | ENO2 |
| 17ABDPNP | linear | EXG1 | Bacillus amyloliquefaciens | 164 | ENO2 |
| 17ABDPMP | linear | EXG1 | Rhizomucor pusillus | 165 | ENO2 |
| 17ABDPLP | linear | EXG1 | Kionochaeta ivoriensis | 166 | ENO2 |
| 17ABDPKP | linear | EXG1 | Aspergillus niger | 167 | ENO2 |
| 17ABDPJP | linear | EXG1 | Aspergillus oryzae | 168 | ENO2 |
| 17ABDPIP | linear | EXG1 | Penicillium canescens | 169 | ENO2 |
| 17ABDPHP | linear | EXG1 | Acidomyces acidothermus | 170 | ENO2 |
| 17ABDQ4P | linear | EXG1 | Kinochaeta ivoriensis | 171 | ENO2 |
| 17ABDQ3P | linear | EXG1 | Aspergillus terreus | 172 | ENO2 |
| 17ABDQ2P | linear | EXG1 | Thamnidium elegans | 173 | ENO2 |
| 17ABDQZP | linear | EXG1 | Meripilus giganteus | 174 | ENO2 |

Figure 3:
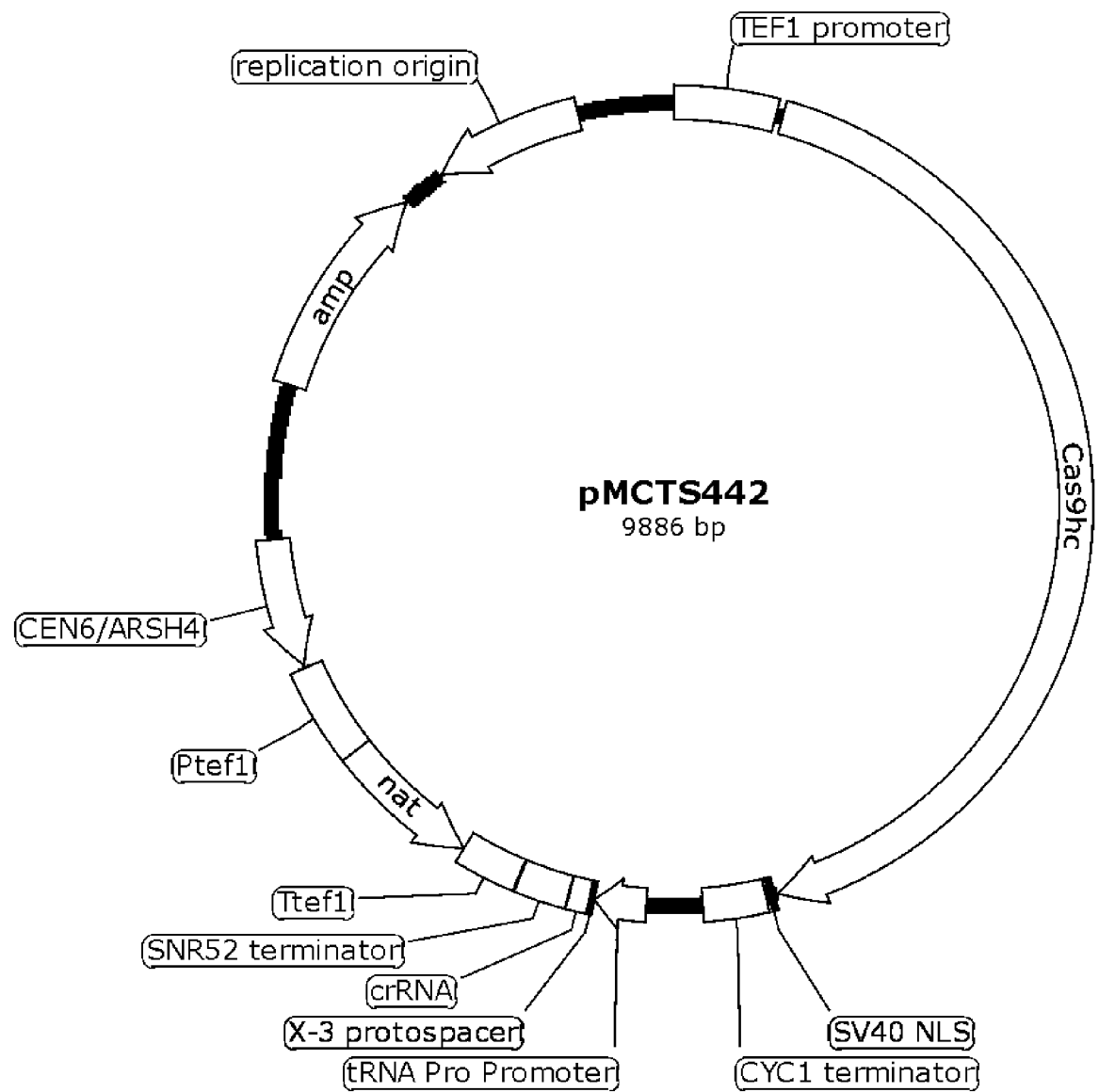
FIG. 3 shows a plasmid map for pMcTs442.

Integration of the Left, Middle and Right-Hand Fragments to Generate Yeast Strains with a Heterologous Alpha-Amylase The yeast yMHCT484 (PCT/US2018/035596) was transformed with the left, middle and right integration fragments described above. In each transformation pool a fixed left fragment and right fragment were used. The middle fragment consisted of a pool of 19-21 middle fragments containing the alpha-amylase gene with 100-600 ng of each fragment (1500 ng total). To aid homologous recombination of the left, middle and right fragments at the genomic X-3 sites a plasmid containing Cas9 and guide RNA specific to X-3 (pMcTs442) was also used in the transformation. These four components were transformed into the into S. cerevisiae strain yMHCT484 following a yeast electroporation protocol (See, Thompson et al. Yeast. 1998 Apr. 30; 14(6):565-71). Transformants were selected on YPD+cloNAT to select for transformants that contain the CRISPR/Cas9 plasmid pMcTs442 (FIG. 3). Transformants were picked using a Q-pix Colony Picking System (Molecular Devices) to inoculate 1 well of 96-well plate containing YPD+clonNAT media. The plates were grown for 2 days then glycerol was added to 20% final concentration and the plates were stored at −80° C. until needed. Integration of specific alpha-amylase construct was verified by PCR with locus specific primers and subsequent sequencing. The strains generated in this example are shown in Table 5.

TABLE 5

Alpha-amylase expressing S. cerevisiae strains.

| left piece | middle piece | Promoter | Signal peptide | Alpha-amylase gene donor (catalytic domain) | SEQ ID NO: (mature polypeptide) | strain ID |
|---|---|---|---|---|---|---|
| 17ABCK4P | 17ABDQJP | ADH1 | EXG1 | Byssoascus striatosporus | 136 | P110-A08 |
| 17ABCK4P | 17ABDQHP | ADH1 | EXG1 | Penicillium subspinulosum | 138 | P110-A09 |
| 17ABCK4P | 17ABDQUP | ADH1 | EXG1 | Acidomyces richmondensis | 125 | P110-B01 |
| 17ABCK4P | 17ABDQKP | ADH1 | EXG1 | Trichoderma paraviridescens | 135 | P110-B04 |

TABLE 5-continued

Alpha-amylase expressing *S. cerevisiae* strains.

| left piece | middle piece | Promoter | Signal peptide | Alpha-amylase gene donor (catalytic domain) | SEQ ID NO: (mature polypeptide) | strain ID |
|---|---|---|---|---|---|---|
| 17ABCK4P | 17ABDQXP | ADH1 | EXG1 | *Bacillus licheniformis* | 122 | P110-B05 |
| 17ABCK4P | 17ABDQMP | ADH1 | EXG1 | *Penicillium aethiopicum* | 133 | P110-B08 |
| 17ABCK4P | 17ABDQSP | ADH1 | EXG1 | *Alternaria* sp | 127 | P110-C05 |
| 17ABCK4P | 17ABDQOP | ADH1 | EXG1 | *Dichotomocladium hesseltinei* | 131 | P110-D01 |
| 17ABCK4P | 17ABDQTP | ADH1 | EXG1 | *Aspergillus bombycis* | 126 | P110-D02 |
| 17ABCK4P | 17ABDQIP | ADH1 | EXG1 | *Aspergillus brasiliensis* | 137 | P110-D10 |
| 17ABCK4P | 17ABDQVP | ADH1 | EXG1 | *Aspergillus tamarii* | 124 | P110-F02 |
| 17ABCK4P | 17ABDQTP | ADH1 | EXG1 | *Aspergillus bombycis* | 126 | P110-F07 |
| 17ABCK4P | 17ABDQHP | ADH1 | EXG1 | *Penicillium subspinulosum* | 138 | P110-G03 |
| 17ABCK4P | 17ABDQUP | ADH1 | EXG1 | *Acidomyces richmondensis* | 125 | P110-G04 |
| 17ABCK4P | 17ABDQSP | ADH1 | EXG1 | *Alternaria* sp | 127 | P110-G06 |
| 17ABCK4P | 17ABDQLP | ADH1 | EXG1 | *Subulispora* sp | 134 | P110-H02 |
| 17ABCK4P | 17ABDQHP | ADH1 | EXG1 | *Penicillium subspinulosum* | 138 | P110-H05 |
| 17ABCK4P | 17ABDQGP | ADH1 | EXG1 | *Penicillium antarcticum* | 139 | P110-H07 |
| 17ABCK4P | 17ABDPZP | ADH1 | EXG1 | *Cerrena unicolor* | 152 | P111-C03 |
| 17ABCK4P | 17ABDQAP | ADH1 | EXG1 | *Neosartorya massa* | 145 | P111-D10 |
| 17ABCK4P | 17ABDQDP | ADH1 | EXG1 | *Penicillium vasconiae* | 142 | P111-F01 |
| 17ABCK4P | 17ABDQCP | ADH1 | EXG1 | *Penicillium* sp | 143 | P111-H08 |
| 17ABCK4P | 17ABDPJP | ADH1 | EXG1 | *Aspergillus oryzae* | 168 | P112-A03 |
| 17ABCK4P | 17ABDQ3P | ADH1 | EXG1 | *Aspergillus terreus* | 172 | P112-A07 |
| 17ABCK4P | 17ABDQ3P | ADH1 | EXG1 | *Aspergillus terreus* | 172 | P112-B11 |
| 17ABCK4P | 17ABDQ2P | ADH1 | EXG1 | *Thamnidium elegans* | 173 | P112-C09 |
| 17ABCK4P | 17ABDPPP | ADH1 | EXG1 | *Bacillus halmapalus* | 162 | P112-D05 |
| 17ABCK4P | 17ABDPJP | ADH1 | EXG1 | *Aspergillus oryzae* | 168 | P112-D06 |
| 17ABCK4P | 17ABDPMP | ADH1 | EXG1 | *Rhizomucor pusillus* | 165 | P112-H03 |
| 17ABCK3P | 17ABDQIP | TDH3 | EXG1 | *Aspergillus brasiliensis* | 137 | P113-A03 |
| 17ABCK3P | 17ABDQYP | TDH3 | EXG1 | *Rhizomucor pusillus* | 121 | P113-B05 |
| 17ABCK3P | 17ABDQXP | TDH3 | EXG1 | *Bacillus licheniformis* | 122 | P113-B06 |
| 17ABCK3P | 17ABDQTP | TDH3 | EXG1 | *Aspergillus bombycis* | 126 | P113-C03 |
| 17ABCK3P | 17ABDQNP | TDH3 | EXG1 | *Lichtheimia ramosa* | 132 | P113-C06 |
| 17ABCK3P | 17ABDQVP | TDH3 | EXG1 | *Aspergillus tamarii* | 124 | P113-C09 |
| 17ABCK3P | 17ABDQYP | TDH3 | EXG1 | *Rhizomucor pusillus* | 121 | P113-C10 |
| 17ABCK3P | 17ABDQRP | TDH3 | EXG1 | *Rhizopus microsporus* | 128 | P113-D07 |
| 17ABCK3P | 17ABDQVP | TDH3 | EXG1 | *Aspergillus tamarii* | 124 | P113-D08 |
| 17ABCK3P | 17ABDQSP | TDH3 | EXG1 | *Alternaria* sp | 127 | P113-D10 |
| 17ABCK3P | 17ABDQNP | TDH3 | EXG1 | *Lichtheimia ramosa* | 132 | P113-F02 |
| 17ABCK3P | 17ABDQQP | TDH3 | EXG1 | *Syncephalastrum racemosum* | 129 | P113-F05 |
| 17ABCK3P | 17ABDQJP | TDH3 | EXG1 | *Byssoascus striatosporus* | 136 | P113-G04 |
| 17ABCK3P | 17ABDQTP | TDH3 | EXG1 | *Aspergillus bombycis* | 126 | P113-G09 |
| 17ABCK3P | 17ABDPSP | TDH3 | EXG1 | *Rhizomucor pusillus* | 159 | P114-A04 |
| 17ABCK3P | 17ABDP4P | TDH3 | EXG1 | *Hamigera avellanea* | 149 | P114-B02 |
| 17ABCK3P | 17ABDPUP | TDH3 | EXG1 | *Bacillus subtilis* subsp. *subtilis* | 157 | P114-B08 |
| 17ABCK3P | 17ABDPUP | TDH3 | EXG1 | *Bacillus subtilis* subsp. *subtilis* | 157 | P114-C01 |
| 17ABCK3P | 17ABDP2P | TDH3 | EXG1 | *Meripilus giganteus* | 151 | P114-C04 |
| 17ABCK3P | 17ABDPVP | TDH3 | EXG1 | *Bacillus subtilis* | 156 | P114-C05 |
| 17ABCK3P | 17ABDQAP | TDH3 | EXG1 | *Neosartorya massa* | 145 | P114-C06 |
| 17ABCK3P | 17ABDQEP | TDH3 | EXG1 | *Penicillium olsonii* | 141 | P114-C07 |
| 17ABCK3P | 17ABDPTP | TDH3 | EXG1 | *Schwanniomyces occidentalis* | 158 | P114-D02 |
| 17ABCK3P | 17ABDPRP | TDH3 | EXG1 | *Aspergillus niger* | 160 | P114-D07 |
| 17ABCK3P | 17ABDP3P | TDH3 | EXG1 | *Hamigera avellanea* | 150 | P114-F06 |
| 17ABCK3P | 17ABDP6P | TDH3 | EXG1 | *Aspergillus brasiliensis* | 147 | P114-F07 |
| 17ABCK3P | 17ABDPUP | TDH3 | EXG1 | *Bacillus subtilis* subsp. *subtilis* | 157 | P114-F08 |
| 17ABCK3P | 17ABDP2P | TDH3 | EXG1 | *Meripilus giganteus* | 151 | P114-H02 |
| 17ABCK3P | 17ABDQAP | TDH3 | EXG1 | *Neosartorya massa* | 145 | P114-H03 |
| 17ABCK3P | 17ABDPZP | TDH3 | EXG1 | *Cerrena unicolor* | 152 | P114-H07 |
| 17ABCK3P | 17ABDQAP | TDH3 | EXG1 | *Neosartorya massa* | 145 | P114-H08 |
| 17ABCK3P | 17ABDPKP | TDH3 | EXG1 | *Aspergillus niger* | 167 | P115-B03 |
| 17ABCK3P | 17ABDPMP | TDH3 | EXG1 | *Rhizomucor pusillus* | 165 | P115-C11 |
| 17ABCK3P | 17ABDPMP | TDH3 | EXG1 | *Rhizomucor pusillus* | 165 | P115-D09 |
| 17ABCK3P | 17ABDQ3P | TDH3 | EXG1 | *Aspergillus terreus* | 172 | P115-F06 |
| 17ABCK3P | 17ABDPJP | TDH3 | EXG1 | *Aspergillus oryzae* | 168 | P115-G04 |

Example 2: Activity Assay of Yeast Strains Expressing Alpha-Amylase

Yeast strains from Example 1 were cultivated overnight in standard YPD media containing 2% or 6% glucose. The cultured yeast medium was subjected to centrifugation at 3500 rpm for 10 min to harvest the supernatant. The culture supernatant is used for enzyme activity assays, as described below. Yeast may also be cultivated using other cultivation media such as minimal YNB media or clarified and filtered industrial liquefied corn mash.

Glucoamylase Activity Assay

Glucoamylase activity was measured using maltose as substrate. Enzyme-catalyzed hydrolysis of maltose yields glucose as the reaction product which can be detected and quantified using commercially available assay kits such as Wako Diagnostics AUTOKIT GLUCOSE C2. Reagents provided in the assay kits react with glucose resulted in a color change with maximal absorbance at 505 nm. The absorbance intensity measured spectrophotometrically is proportional to glucoamylase activity. The absorbance at 505 nm can be fit to standard curve generated using a purified glucoamylase enzyme to estimate enzyme activity. Reaction conditions and color development are described in Table 5 and Table 6, respectively. Glucoamylase units (AGU) for glucoamylase activity is defined as the amount of enzyme required to hydrolyze one micromole maltose per minute under the reaction conditions.

TABLE 5

Glucoamylase reaction conditions

| | |
|---|---|
| Appropriate amount of yeast supernatant | 10-200 µl |
| Substrate | maltose, 10 mM |
| Buffer | acetate, 0.1M |
| pH | 5.0 ± 0.05 |
| Incubation temperature | 32° C. |
| Reaction time | 5-20 min |
| Glucoamylase assay range | 0.001-0.036 AGU/ml |

TABLE 6

Color development

| | |
|---|---|
| Reaction mixture | 10 µl |
| AUTOKIT GLUCOSE C2 developing reagent | 200 µl |
| Incubation temperature | room temperature or 37° C. |
| Reaction time | 10-25 min |
| Wavelength | 505 nm |

Alpha Amylase Activity Assay

Alpha amylase activity was measured using blocked-p-nitrophenyl-maltoheptaoside (BPNPG7) as substrate, which is included as the amylase HR reagent from Megazymes. Enzyme hydrolysis of the alpha-bond of BPNPG7 releases a blocked maltosaccharide oligomer and a p-nitrophenyl maltosaccharide oligomer. The p-nitrophenyl maltosaccharide will react with a glucoamylase from Megayzmes yielding p-nitrophenol which may be detected using commercially available assay kits such as MEGAZYMES R-AMHR4. Reagents provided in the assay kits will specifically react with p-nitrophenol resulting in color formation. The color intensity measured using a spectrophotometer or microplate reader is proportional to alpha-amylase activity. Reaction conditions and color development are described in Table 7 and Table 8, respectively.

TABLE 7

Alpha-amylase reaction conditions

| | |
|---|---|
| Appropriate amount of yeast supernatant | 10-200 µl |
| Substrate | blocked-p-nitrophenyl-maltoheptaoside (BPNPG7), 10 mM |
| Buffer | acetate, 0.1M |
| pH | 5.0 ± 0.05 |
| Incubation temperature | 32° C. |
| Reaction time | 20 min |
| Alpha amylase assay range | 5-200 ng/ml |

TABLE 8

Color development

| | |
|---|---|
| Reaction mixture | 20 µl |
| blocked-p-nitrophenyl-maltoheptaoside (BPNPG7) | 80 µl |
| Stop solution (4% Tris) | 100 µl |
| Incubation temperature | Room temperature - 32° C. |
| Reaction time | 10-25 min |
| Wavelength | 400 nm |

Results

The absorbance at 505 nm increases as the amount of purified glucoamylase added to hydrolyze maltose to glucose increases. The absorbance at 400 nm increases as the amount of purified alpha-amylase added increases. Specifically, the alpha-amylase hydrolyzes blocked-p-nitrophenyl-maltoheptaoside (BPNPG7) releasing a blocked maltosaccharide oligomer and a p-nitrophenyl maltosaccharide oligomer. The p-nitrophenyl maltosaccharide reacts with a glucoamylase from Megayzmes yielding p-nitrophenol which absorbs at 400 nm. A purified glucoamylase and alpha amylase standard curve was generated and used to estimate glucoamylase and alpha-amylase activity in yeast supernatants.

Results for alpha-amylase activity and glucoamylase activity are shown Table 9. A graphical representation of comparative alpha-amylase activity is shown in FIG. 1.

TABLE 9

Alpha-amylase (AA) and glucoamylase (GA) activity and estimated secretion

| Yeast strain no. | Promoter for alpha-amylase expression | SEQ ID NO: (mature polypeptide) | AA gene donor (catalytic domain) | Glucoamylase activity | Conc. (ug/mL) | Alpha-amylase activity | Conc. (ug/mL) |
|---|---|---|---|---|---|---|---|
| 1 | Background strain with glucoamylase gene, without alpha amylase gene | | | 1.03 | 10.6 | N/A | N/A |
| 1 | Background strain with glucoamylase gene, without alpha amylase gene | | | 0.98 | 9.8 | N/A | N/A |

TABLE 9-continued

Alpha-amylase (AA) and glucoamylase (GA) activity and estimated secretion

| Yeast strain no. | Promoter for alpha-amylase expression | SEQ ID NO: (mature polypeptide) | AA gene donor (catalytic domain) | Glucoamylase activity | Glucoamylase Conc. (ug/mL) | Alpha-amylase activity | Alpha-amylase Conc. (ug/mL) |
|---|---|---|---|---|---|---|---|
| 1 | Background strain with glucoamylase gene, without alpha amylase gene | | | 1.00 | 10.0 | N/A | N/A |
| 2 | PADH1 | 125 | *Acidomyces richmondensis* | 0.86 | 8.1 | 0.1753 | 0.04 |
| 3 | pADH1 | 125 | *Acidomyces richmondensis* | 1.03 | 10.6 | 0.5529 | 0.16 |
| 4 | PADH1 | 136 | *Byssoascus striatosporus* | 0.76 | 6.6 | 0.084 | 0.01 |
| 5 | pADH1 | 162 | *Bacillus halmapalus* | 1.58 | 18.5 | 0.4314 | 0.12 |
| 6 | pADH1 | 172 | *Aspergillus terreus* | 0.91 | 8.8 | 1.4154 | 0.44 |
| 7 | pTDH3 | 129 | *Syncephalastrum racemosum* | 0.87 | 8.2 | 1.3655 | 0.43 |
| 8 | pTDH3 | 151 | *Meripilus* | 0.60 | 4.3 | 1.6636 | 0.52 |
| 9 | pTDH3 | 141 | *Penicillium olsonii* | 0.99 | 10.0 | 0.0846 | 0.01 |
| 11 | pADH1 | 131 | *Dichotomocladium hesseltinei* | 0.75 | 6.5 | 0.084 | 0.01 |
| 12 | pADH1 | 122 | *Bacillus licheniformis* | 0.93 | 9.1 | 0.1147 | 0.02 |
| 13 | pADH1 | 133 | *Penicillium aethiopicum* | 1.03 | 10.5 | 0.0842 | 0.01 |
| 14 | pADH1 | 143 | *Penicillium* sp | 0.88 | 8.4 | 0.2047 | 0.05 |
| 15 | pADH1 | 168 | *Aspergillus oryzae* | 0.90 | 8.7 | 1.561 | 0.49 |
| 16 | pTDH3 | 122 | *Bacillus licheniformis* | 0.81 | 7.3 | 0.1219 | 0.02 |
| 17 | pTDH3 | 126 | *Aspergillus bombycis* | 0.98 | 9.8 | 0.1628 | 0.03 |
| 18 | pTDH3 | 145 | *Neosartorya massa* | 0.92 | 8.9 | 1.902 | 0.60 |
| 19 | pTDH3 | 160 | *Aspergillus niger* | 0.95 | 9.3 | 0.0899 | 0.01 |
| 20 | pTDH3 | 167 | *Aspergillus niger* | 0.98 | 9.8 | 1.2357 | 0.38 |
| 21 | pADH1 | 126 | *Aspergillus bombycis* | 0.95 | 9.3 | 0.3891 | 0.11 |
| 22 | pADH1 | 127 | *Alternaria* sp | 0.93 | 9.1 | 0.0866 | 0.01 |
| 23 | pADH1 | 138 | *Penicillium subspinulosum* | 0.97 | 9.7 | 0.0848 | 0.01 |
| 24 | pADH1 | 145 | *Neosartorya massa* | 0.93 | 9.1 | 0.8786 | 0.27 |
| 25 | pTDH3 | 132 | *Lichtheimia ramosa* | 0.89 | 8.5 | 1.1903 | 0.37 |
| 26 | pTDH3 | 132 | *Lichtheimia ramosa* | 0.88 | 8.3 | 1.7498 | 0.55 |
| 27 | pTDH3 | 121 | *Rhizomucor pusillus* | 0.78 | 7.0 | 1.334 | 0.42 |
| 28 | pTDH3 | 159 | *Aspergillus niger* | 0.90 | 8.7 | 1.9582 | 0.62 |
| 29 | pTDH3 | 147 | *Aspergillus brasiliensis* | 1.03 | 10.6 | 0.3469 | 0.09 |
| 30 | pTDH3 | 168 | *Aspergillus oryzae* | 0.92 | 9.0 | 1.5655 | 0.49 |
| 31 | pADH1 | 124 | *Aspergillus tamarii* | 0.87 | 8.3 | 1.1583 | 0.36 |
| 32 | pADH1 | 138 | *Penicillium subspinulosum* | 0.90 | 8.7 | 0.0848 | 0.01 |
| 34 | pADH1 | 172 | *Aspergillus terreus* | 0.88 | 8.4 | 1.3645 | 0.43 |
| 35 | pTDH3 | 137 | *Aspergillus brasiliensis* | 0.92 | 8.9 | 1.2183 | 0.38 |
| 36 | pTDH3 | 169 | *Penicillium canescens* | 0.83 | 7.7 | 1.8212 | 0.57 |
| 37 | pTDH3 | 127 | *Alternaria* sp | 0.95 | 9.4 | 0.0877 | 0.01 |
| 38 | pTDH3 | 151 | *Meripilus* | 0.56 | 3.8 | 1.3665 | 0.43 |
| 39 | pTDH3 | 152 | *Cerrena unicolor* | 0.98 | 9.8 | 0.0831 | 0.01 |
| 40 | pTDH3 | 172 | *Aspergillus terreus* | 0.98 | 9.9 | 0.8774 | 0.27 |
| 41 | pADH1 | 134 | *Subulispora* sp | 0.72 | 6.1 | 0.0916 | 0.01 |
| 42 | pADH1 | 127 | *Alternaria* sp | 0.80 | 7.3 | 0.0938 | 0.01 |
| 43 | pADH1 | 137 | *Aspergillus brasiliensis* | 0.94 | 9.2 | 1.1772 | 0.36 |
| 44 | pADH1 | 168 | *Aspergillus oryzae* | 0.92 | 9.0 | 1.5347 | 0.48 |
| 46 | pTDH3 | 126 | *Aspergillus bombycis* | 1.03 | 10.5 | 0.1955 | 0.05 |
| 47 | pTDH3 | 128 | *Rhizopus microsporus* | 0.65 | 5.1 | 0.9639 | 0.30 |
| 48 | pTDH3 | 157 | *Bacillus subtilis* subsp. *subtilis* | 0.94 | 9.2 | 1.2992 | 0.40 |
| 49 | pTDH3 | 156 | *Bacillus subtilis* | 0.93 | 9.1 | 1.1427 | 0.35 |
| 50 | pTDH3 | 157 | *Bacillus subtilis* subsp. *subtilis* | 0.95 | 9.4 | 1.3374 | 0.42 |
| 51 | pADH1 | 140 | *Penicillium coprophilum* | 0.90 | 8.6 | 0.7588 | 0.23 |
| 52 | pADH1 | 136 | *Byssoascus striatosporus* | 0.94 | 9.2 | 0.085 | 0.01 |
| 53 | pADH1 | 146 | *Penicillium janthinellum* | 0.79 | 7.0 | 0.3325 | 0.09 |
| 54 | pADH1 | 173 | *Thamnidium elegans* | 0.91 | 8.8 | 1.1844 | 0.37 |
| 55 | pADH1 | 163 | *Aspergillus oryzae* | 0.88 | 8.4 | 1.7175 | 0.54 |

TABLE 9-continued

Alpha-amylase (AA) and glucoamylase (GA) activity and estimated secretion

| Yeast strain no. | Promoter for alpha-amylase expression | SEQ ID NO: (mature polypeptide) | AA gene donor (catalytic domain) | Glucoamylase activity | Glucoamylase Conc. (ug/mL) | Alpha-amylase activity | Alpha-amylase Conc. (ug/mL) |
|---|---|---|---|---|---|---|---|
| 56 | pTDH3 | 137 | Aspergillus brasiliensis | 0.93 | 9.0 | 0.9012 | 0.27 |
| 57 | pTDH3 | 123 | Aspergillus niger | 0.94 | 9.2 | 1.2994 | 0.40 |
| 58 | pTDH3 | 150 | Hamigera avellanea | 0.87 | 8.3 | 0.7698 | 0.23 |
| 59 | pTDH3 | 149 | Hamigera avellanea | 0.89 | 8.5 | 0.8048 | 0.24 |
| 60 | pTDH3 | 165 | Rhizomucor pusillus | 0.94 | 9.3 | 1.9117 | 0.60 |
| 61 | PADH1 | 138 | Penicillium subspinulosum | 0.76 | 6.7 | 0.1233 | 0.02 |
| 62 | PADH1 | 126 | Aspergillus bombycis | 0.94 | 9.3 | 0.3626 | 0.10 |
| 63 | pADH1 | 142 | Penicillium vasconiae | 0.74 | 6.4 | 0.1007 | 0.01 |
| 64 | pADH1 | 165 | Rhizomucor pusillus | 0.94 | 9.3 | 1.7183 | 0.54 |
| 66 | pTDH3 | 136 | Byssoascus striatosporus | 0.96 | 9.6 | 0.084 | 0.01 |
| 67 | pTDH3 | 124 | Aspergillus tamarii | 0.90 | 8.6 | 1.0263 | 0.32 |
| 68 | pTDH3 | 149 | Hamigera avellanea | 1.04 | 10.7 | 0.4173 | 0.12 |
| 69 | pTDH3 | 145 | Neosartorya massa | 0.96 | 9.5 | 0.2249 | 0.05 |
| 70 | pTDH3 | 157 | Bacillus subtilis subsp. subtilis | 0.99 | 9.9 | 1.4 | 0.44 |
| 71 | pTDH3 | 165 | Rhizomucor pusillus | 0.89 | 8.4 | 2.2181 | 0.70 |
| 72 | pADH1 | 135 | Trichoderma paraviridescens | 0.92 | 9.0 | 0.0873 | 0.01 |
| 73 | pADH1 | 139 | Penicillium antarcticum | 0.78 | 6.9 | 0.0926 | 0.01 |
| 74 | pADH1 | 152 | Cerrena unicolor | 0.93 | 9.1 | 0.0858 | 0.01 |
| 76 | pADH1 | 173 | Thamnidium elegans | 0.89 | 8.6 | 1.2458 | 0.39 |
| 77 | pTDH3 | 121 | Rhizomucor pusillus | 0.80 | 7.2 | 1.6326 | 0.51 |
| 78 | pTDH3 | 124 | Aspergillus tamarii | 0.80 | 7.3 | 1.2964 | 0.40 |
| 79 | pTDH3 | 158 | Schwanniomyces occidentalis | 1.00 | 10.0 | 0.2679 | 0.07 |
| 80 | pTDH3 | 150 | | 0.83 | 7.7 | 0.7079 | 0.21 |
| 81 | pTDH3 | 145 | Neosartorya massa | 0.90 | 8.7 | 0.1957 | 0.05 |
| 82 | pTDH3 | 165 | Rhizomucor pusillus | 0.81 | 7.3 | 2.1273 | 0.67 |

Example 3: Simultaneous Saccharification and Fermentation (SSF) of Yeast Strains Expressing Alpha-Amylase Yeast strains were cultivated overnight in standard YPD media containing 2% glucose. The cultured yeast medium was centrifuged at 3000 rpm for 10 min to collect the supernatant. The supernatant was used for enzyme activity assay, as described below.

Alpha Amylase Activity Assay

Alpha-amylase activity was detected by measuring the amount of starch degraded through enzymatic hydrolysis of starch. Potassium iodide and iodine reagent was used to measure the residual starch based on the color development from application of the reagent. The color intensity measured on a spectrophotometer or microplate reader is inversely proportional to alpha-amylase activity. Reaction conditions and color development were described in Table 11 and Table 12, respectively.

TABLE 11

| Alpha-amylase reaction condition | |
|---|---|
| Amount of yeast supernatant | 20 μl |
| Amount of substrate | 130 μl |
| Substrate | 2 mM starch |
| Buffer | Sodium acetate, 0.1M, 0.01% Triton 100 |
| pH | 5.0 ± 0.05 |
| Incubation temperature | 20° C. |
| Reaction time | 2-3 hr |

TABLE 12

| Color development | |
|---|---|
| Reaction mixture | 150 μl |
| Amount of reagent | 50 μl |
| Reagent | 14.5 mM potassium iodide, 0.9 mM iodine |
| Incubation temperature | 20° C. |
| Reaction time | 10-15 min |
| Wavelength | 595 nm |

Simultaneous saccharification and fermentation (SSF) was performed via mini-scale fermentations using industrial corn mash (Avantec® Amp, Novozymes, A/S) using conditions shown in Table 13. Yeast strains were cultivated overnight in YPD media with 2% glucose for 24 hours at 30° C. and 300 rpm. The corn mash was supplemented with 250 ppm of urea. Approximately 0.6 mg of corn mash was dispensed per well to 96 well microtiter plates, followed by the addition of approximately $10^8$ yeast cells/g of corn mash from the overnight culture. Plates were incubated at 32° C. without shaking. Duplicates of each strain were analyzed after 48 hour fermentations. Fermentation was stopped by the addition of 100 μL of 8% $H_2SO_4$, followed by centrifugation at 3000 rpm for 10 min. The supernatant was analyzed for ethanol using HPLC.

TABLE 13

Microtiter plate fermentation reaction conditions

| | |
|---|---|
| Substrate | Avantec ® Amp corn mash |
| Yeast pitch | 10^8 cells/g corn mash |
| Supplementary urea | 250 ppm |
| pH | 5.0 ± 0.05 |
| Incubation temperature | 32° C. |
| Reaction time | 48 hours |

As shown in Table 14, higher ethanol was obtained from yeast expressing a heterologous alpha-amylase compared to yeast lacking heterologous alpha-amylase expression. "Mean (residual starch)" column shows the results from the YPD based alpha-amylase activity assay where the residual starch is inversely proportional to alpha-amylase activity, while "Mean (normalized ethanol)" columns shows the ethanol at the 48 hour timepoint from two different simultaneous and saccharification fermentation (SSF) experiments, normalized to that of the strain without heterologous alpha-amylase expression (yMHCT484).

TABLE 14

Strain IDs and normalized ethanol and alpha-amylase activity data.

| Promoter | Signal peptide | Alpha-amylase gene donor (catalytic domain) | SEQ ID NO: (mature polypeptide) | Mean (normalized ethanol) (exp 1) | Mean (normalized ethanol) (exp 2) | Mean (residual starch) |
|---|---|---|---|---|---|---|
| Background strain with glucoamylase gene, without alpha amylase gene | | | | 1.00 | 1.00 | 0.74 |
| ADH1 | EXG1 | Byssoascus striatosporus | 136 | 1.18 | 0.69 | 1.007 |
| ADH1 | EXG1 | Penicillium subspinulosum | 138 | 1.27 | 0.97 | 1.029 |
| ADH1 | EXG1 | Acidomyces richmondensis | 125 | 1.10 | 0.88 | 0.414 |
| ADH1 | EXG1 | Trichoderma paraviridescens | 135 | 1.14 | 0.78 | 0.564 |
| ADH1 | EXG1 | Bacillus licheniformis | 122 | 1.28 | 0.85 | 0.453 |
| ADH1 | EXG1 | Penicillium aethiopicum | 133 | 1.19 | 0.97 | 0.954 |
| ADH1 | EXG1 | Alternaria sp | 127 | 1.17 | 0.97 | 0.460 |
| ADH1 | EXG1 | Dichotomocladium hesseltinei | 131 | 1.15 | 0.74 | 0.980 |
| ADH1 | EXG1 | Aspergillus bombycis | 126 | 1.13 | 0.98 | 0.423 |
| ADH1 | EXG1 | Aspergillus brasiliensis | 137 | 1.16 | 1.06 | 0.507 |
| ADH1 | EXG1 | Aspergillus tamarii | 124 | 1.22 | 1.04 | 0.440 |
| ADH1 | EXG1 | Aspergillus bombycis | 126 | 1.14 | 0.97 | 0.479 |
| ADH1 | EXG1 | Acidomyces richmondensis | 125 | 1.11 | 1.00 | 0.464 |
| ADH1 | EXG1 | Alternaria sp | 127 | 1.13 | 0.77 | 0.411 |
| ADH1 | EXG1 | Subulispora sp | 134 | 1.03 | 0.64 | 0.452 |
| ADH1 | EXG1 | Penicillium subspinulosum | 138 | 1.11 | 0.82 | 0.607 |
| ADH1 | EXG1 | Penicillium antarcticum | 139 | 1.17 | 0.71 | 0.476 |
| ADH1 | EXG1 | Cerrena unicolor | 152 | 1.07 | 0.95 | 0.533 |
| ADH1 | EXG1 | Neosartorya massa | 145 | 1.05 | 1.13 | 0.422 |
| ADH1 | EXG1 | Penicillium vasconiae | 142 | 1.15 | 0.72 | 0.394 |
| ADH1 | EXG1 | Penicillium sp | 143 | 1.09 | 0.88 | 0.412 |
| ADH1 | EXG1 | Aspergillus oryzae | 168 | 1.21 | 1.16 | 0.038 |
| ADH1 | EXG1 | Aspergillus terreus | 172 | 1.15 | 1.22 | 0.038 |
| ADH1 | EXG1 | Aspergillus terreus | 172 | 1.17 | 1.22 | 0.037 |
| ADH1 | EXG1 | Thamnidium elegans | 173 | 1.25 | 1.13 | 0.037 |
| ADH1 | EXG1 | Aspergillus oryzae | 168 | 1.10 | 1.16 | 0.044 |
| ADH1 | EXG1 | Rhizomucor pusillus | 165 | 1.23 | 1.23 | 0.036 |
| TDH3 | EXG1 | Aspergillus brasiliensis | 137 | 1.16 | 1.07 | 0.042 |
| TDH3 | EXG1 | Rhizomucor pusillus | 121 | 1.27 | 1.20 | 0.040 |
| TDH3 | EXG1 | Bacillus licheniformis | 122 | 0.91 | 0.93 | 0.046 |
| TDH3 | EXG1 | Aspergillus bombycis | 126 | 1.20 | 0.97 | 0.039 |
| TDH3 | EXG1 | Lichtheimia ramosa | 132 | 1.19 | 1.12 | 0.051 |
| TDH3 | EXG1 | Aspergillus tamarii | 124 | 1.21 | 1.11 | 0.048 |
| TDH3 | EXG1 | Rhizopus microsporus | 128 | 1.02 | 1.01 | 0.041 |
| TDH3 | EXG1 | Aspergillus tamarii | 124 | 1.18 | 1.04 | 0.040 |
| TDH3 | EXG1 | Syncephalastrum racemosum | 129 | 1.17 | 1.24 | 0.042 |
| TDH3 | EXG1 | Byssoascus striatosporus | 136 | 1.04 | 0.96 | 0.541 |
| TDH3 | EXG1 | Aspergillus bombycis | 126 | 1.05 | 0.97 | 0.042 |

TABLE 14-continued

Strain IDs and normalized ethanol and alpha-amylase activity data.

| Promoter | Signal peptide | Alpha-amylase gene donor (catalytic domain) | SEQ ID NO: (mature polypeptide) | Mean (normalized ethanol) (exp 1) | Mean (normalized ethanol) (exp 2) | Mean (residual starch) |
|---|---|---|---|---|---|---|
| TDH3 | EXG1 | Rhizomucor pusillus | 159 | | 1.25 | 0.141 |
| TDH3 | EXG1 | Hamigera avellanea | 149 | 1.11 | 1.03 | 0.055 |
| TDH3 | EXG1 | Bacillus subtilis subsp. subtilis | 157 | 1.19 | 1.08 | 0.043 |
| TDH3 | EXG1 | Bacillus subtilis subsp. subtilis | 157 | 1.25 | 1.11 | 0.044 |
| TDH3 | EXG1 | Meripilus giganteus | 151 | 1.20 | 1.14 | 0.045 |
| TDH3 | EXG1 | Bacillus subtilis | 156 | 1.35 | 1.27 | 0.048 |
| TDH3 | EXG1 | Neosartorya massa | 145 | 1.15 | 1.03 | 0.048 |
| TDH3 | EXG1 | Penicillium olsonii | 141 | 0.96 | 0.98 | 0.052 |
| TDH3 | EXG1 | Aspergillus niger | 160 | 1.06 | 0.98 | 0.053 |
| TDH3 | EXG1 | Hamigera avellanea | 150 | 1.11 | 1.04 | 0.046 |
| TDH3 | EXG1 | Bacillus subtilis subsp. subtilis | 157 | 1.16 | 1.13 | 0.045 |
| TDH3 | EXG1 | Meripilus giganteus | 151 | 1.11 | 1.14 | 0.039 |
| TDH3 | EXG1 | Cerrena unicolor | 152 | 1.02 | 0.96 | 0.546 |
| TDH3 | EXG1 | Neosartorya massa | 145 | 1.25 | 1.04 | 0.053 |
| TDH3 | EXG1 | Aspergillus niger | 167 | 1.08 | 1.05 | 0.040 |
| TDH3 | EXG1 | Rhizomucor pusillus | 165 | 1.30 | 1.23 | 0.039 |
| TDH3 | EXG1 | Aspergillus terreus | 172 | 1.13 | 1.11 | 0.043 |
| TDH3 | EXG1 | Aspergillus oryzae | 168 | 1.13 | 1.17 | 0.037 |

Example 4: Construction of Yeast Strains Expressing a Heterologous Trehalase

This example describes the construction of yeast cells containing a heterologous trehalase under control of an *S. cerevisiae* CCW12 promoter (SEQ ID NO: 232) or PGK1 promoter (SEQ ID NO: 4). Three pieces of DNA containing the promoter, gene and terminator were designed to allow for homologous recombination between the 3 DNA fragments and into the X-3 locus of the yeast yMHCT484 (PCT/US2018/035596). The resulting strain has one promoter containing fragment (left), one gene containing fragment (middle) and one TEF1 terminator (SEQ ID NO: 233) fragment (right) integrated into the *S. cerevisiae* genome at the X-3 locus.

Construction of the Promoter Containing Fragments (Left Fragments)

Synthetic linear uncloned DNA containing 300 bp homology to the X-3 site, *S. cerevisiae* promoter CCW12 (SEQ ID NO: 232) or PGK1 (SEQ ID NO: 4) and *S. cerevisiae* AGA2 signal sequence (SEQ ID NO: 234) were synthetized by Thermo Fisher Scientific. The 2 linear DNAs were designated 17ABCK6P and 17ABCK7P for each promoter listed above, respectively.

To generate additional linear DNA for transformation into yeast, the DNA containing the left cassette was PCR amplified from 17ABCK6P and 17ABCK7P. Fifty pmoles each of forward and reverse primer was used in a PCR reaction containing 12.5 ng of linear DNA as template, 0.1 mM each dATP, dGTP, dCTP, dTTP, 1×Phusion HF Buffer (Thermo Fisher Scientific), and 2 units Phusion Hot Start DNA polymerase in a final volume of 50 μL. The PCR was performed in a T100™ Thermal Cycler (Bio-Rad Laboratories, Inc.) programmed for one cycle at 98° C. for 1 minute followed by 32 cycles each at 98° C. for 10 seconds, 60° C. for 30 seconds, and 72° C. for 1 minute with a final extension at 72° C. for 10 minutes. Following thermocycling, the PCR reaction products gel isolated and cleaned up using the NucleoSpin Gel and PCR clean-up kit (Machery-Nagel).

Construction of the Trehalase Containing Fragments (Middle Fragments)

Synthetic linear uncloned DNA containing *S. cerevisiae* AGA2 signal peptide coding sequence (encoding the signal of SEQ ID NO: 234), a codon-optimized trehalase gene and 50 bp of TEF1 terminator (SEQ ID NO: 233), were synthetized by Thermo Fisher Scientific. The resulting linear DNAs were designated as indicated in Table 15.

A subset of the trehalase containing fragments were ordered as cloned synthetic plasmid DNA rather than linear uncloned DNA. Synthetic plasmid DNA containing *S. cerevisiae* AGA2 signal coding sequence, a codon-optimized trehalase gene and 50 bp of TEF1 terminator, were synthetized by Thermo Fisher Scientific. The resulting DNAs were designated as indicated in Table 15.

Construction of the Terminator Contain Fragment (Right Fragment) Synthetic linear uncloned DNA containing *S. cerevisiae* TEF1 terminator and 300 bp homology to the X-3 site, were synthetized by Thermo Fisher Scientific.

TABLE 15

Trehalase DNA product names and associated enzyme

| Product number | DNA format | Signal Peptide | Donor Organism (catalytic domain) | SEQ ID NO: (mature polypeptide) | Terminator Fragment |
|---|---|---|---|---|---|
| 17ABFBKP | linear | AGA2 | Chaetomium megalocarpum | 175 | TEF1 |
| 17ABFBJP | linear | AGA2 | Lecanicillium psalliotae | 176 | TEF1 |
| 17ABFBIP | linear | AGA2 | Doratomyces sp | 177 | TEF1 |

TABLE 15-continued

Trehalase DNA product names and associated enzyme

| Product number | DNA format | Signal Peptide | Donor Organism (catalytic domain) | SEQ ID NO: (mature polypeptide) | Terminator Fragment |
|---|---|---|---|---|---|
| 17ABFBHP | linear | AGA2 | Mucor moelleri | 178 | TEF1 |
| 17ABFBGP | linear | AGA2 | Phialophora cyclaminis | 179 | TEF1 |
| 17ABFBFP | linear | AGA2 | Thielavia arenaria | 180 | TEF1 |
| 17ABFBEP | linear | AGA2 | Thielavia antarctica | 181 | TEF1 |
| 17ABFBDP | linear | AGA2 | Chaetomium sp | 182 | TEF1 |
| 17ABFBCP | linear | AGA2 | Chaetomium nigricolor | 183 | TEF1 |
| 17ABFBBP | linear | AGA2 | Chaetomium jodhpurense | 184 | TEF1 |
| 17ABFBAP | linear | AGA2 | Chaetomium piluliferum | 185 | TEF1 |
| 17ABFA7P | linear | AGA2 | Myceliophthora hinnulea | 186 | TEF1 |
| 17ABFA6P | linear | AGA2 | Chloridium virescens | 187 | TEF1 |
| 17ABFA5P | linear | AGA2 | Gelasinospora cratophora | 188 | TEF1 |
| 17ABFA4P | linear | AGA2 | Acidobacteriaceae bacterium | 189 | TEF1 |
| 17ABFA3P | linear | AGA2 | Acidobacterium capsulatum | 190 | TEF1 |
| 17ABFA2P | linear | AGA2 | Acidovorax wautersii | 191 | TEF1 |
| 17ABFAZP | linear | AGA2 | Xanthomonas arboricola | 192 | TEF1 |
| 17ABFAYP | linear | AGA2 | Kosakonia sacchari | 193 | TEF1 |
| 17ABFAXP | linear | AGA2 | Enterobacter sp | 194 | TEF1 |
| 17ABFAWP | linear | AGA2 | Saitozyma flava | 195 | TEF1 |
| 17ABFAVP | linear | AGA2 | Phaeotremella skinneri | 196 | TEF1 |
| 17ABFAUP | linear | AGA2 | Trichoderma asperellum | 197 | TEF1 |
| 17ABFATP | linear | AGA2 | Corynascus sepedonium | 198 | TEF1 |
| 17ABFASP | linear | AGA2 | Myceliophthora thermophila | 199 | TEF1 |
| 17ABFARP | linear | AGA2 | Trichoderma reesei GH37 | 200 | TEF1 |
| 17ABFAQP | linear | AGA2 | Chaetomium virescens | 201 | TEF1 |
| 17ABFAPP | linear | AGA2 | Rhodothermus marinus | 202 | TEF1 |
| 17ABFAOP | linear | AGA2 | Myceliophthora sepedonium | 203 | TEF1 |
| 17ABFANP | linear | AGA2 | Moelleriella libera | 204 | TEF1 |
| 17ABFAMP | linear | AGA2 | Acremonium dichromosporum | 205 | TEF1 |
| 17ABFALP | linear | AGA2 | Fusarium sambucinum | 206 | TEF1 |
| 17ABFAKP | linear | AGA2 | Phoma sp | 207 | TEF1 |
| 17ABFAJP | linear | AGA2 | Lentinus similis | 208 | TEF1 |
| 17ABFAIP | linear | AGA2 | Diaporthe nobilis | 209 | TEF1 |
| 17ABFAHP | linear | AGA2 | Solicoccozyma terricola | 210 | TEF1 |
| 17ABFAGP | linear | AGA2 | Dioszegia cryoxerica | 211 | TEF1 |
| 17ABFO6P | plasmid | AGA2 | Talaromyces funiculosus | 212 | TEF1 |
| 17ABFO5P | plasmid | AGA2 | Hamigera avellanea | 213 | TEF1 |
| 17ABFO4P | plasmid | AGA2 | Talaromyces ruber | 214 | TEF1 |
| 17ABFO3P | plasmid | AGA2 | Trichoderma lixii | 215 | TEF1 |
| 17ABFO2P | plasmid | AGA2 | Aspergillus cervinus | 216 | TEF1 |
| 17ABFOZP | plasmid | AGA2 | Rasamsonia brevistipitata | 217 | TEF1 |
| 17ABFOYP | plasmid | AGA2 | Acremonium curvulum | 218 | TEF1 |
| 17ABFOXP | plasmid | AGA2 | Talaromyces piceae | 219 | TEF1 |
| 17ABFOWP | plasmid | AGA2 | Penicillium sp | 220 | TEF1 |
| 17ABFOVP | plasmid | AGA2 | Talaromyces aurantiacus | 221 | TEF1 |
| 17ABFOUP | plasmid | AGA2 | Talaromyces pinophilus | 222 | TEF1 |
| 17ABFOTP | plasmid | AGA2 | Talaromyces leycettanus | 223 | TEF1 |
| 17ABFOSP | plasmid | AGA2 | Talaromyces variabilis | 224 | TEF1 |
| 17ABFORP | plasmid | AGA2 | Aspergillus niger | 225 | TEF1 |
| 17ABFOQP | plasmid | AGA2 | Trichoderma reesei GH65 | 226 | TEF1 |

Integration of the Left, Middle and Right-Hand Fragments to Generate Yeast Strains with a Heterologous Trehalase The yeast yMHCT484 (PCT/US2018/035596) was transformed with the left, middle and right integration fragments described above. In each transformation pool a fixed left fragment and right fragment were used. The middle fragment consisted of a pool of 13-21 middle fragments containing the trehalase gene with 100-600 ng of each fragment (1000 ng total). To aid homologous recombination of the left, middle and right fragments at the genomic X-3 sites a plasmid containing Cas9 and guide RNA specific to X-3 (pMcTs442) was also used in the transformation. These four components were transformed into the into S. cerevisiae strain yMHCT484 following a yeast electroporation protocol (See, Thompson et al. Yeast. 1998 Apr. 30; 14(6):565-71). Transformants were selected on YPD+cloNAT to select for transformants that contain the CRISPR/Cas9 plasmid pMcTs442. Transformants were picked using a Q-pix Colony Picking System (Molecular Devices) to inoculate 1 well of 96-well plate containing YPD+clonNAT media. The plates were grown for 2 days then glycerol was added to 20% final concentration and the plates were stored at −80° C. until needed. Integration of specific trehalase construct was verified by PCR with locus specific primers and subsequent sequencing.

Example 5: Activity Assay of Yeast Strain Expressing Trehalase

Yeast expressing a trehalase gene from Corynascus sepedonium driven by the promoter ADH1 (supra) was cultivated overnight in standard YPD media containing 2% glucose. The cultured yeast medium was centrifuged at 3000 rpm for 10 min to collect the supernatant. The supernatant was used for enzyme activity assay, as described below.

Trehalase activity was detected by measuring the amount of glucose released through enzymatic hydrolysis of trehalose. Glucose oxidase reagent was used to measure the glucose based on the color development from application of the reagent. The color intensity measured on a spectrophotometer or microplate reader is proportional to trehalase activity. Reaction conditions and color development are described in Table 16 and Table 17, respectively.

The Trehalase Novozymes Unit (TNU(A)) for trehalase assay standard is measured relative to an enzyme standard of declared activity.

TABLE 16

Trehalase reaction condition

| | |
|---|---|
| Amount of yeast supernatant | 20 μl |
| Amount of substrate | 100 μl |
| Substrate | Trehalose, 60 mM |
| Buffer | Sodium acetate, 0.1M, 0.01% Triton 100 |
| pH | 5.0 ± 0.05 |
| Incubation temperature | 20° C. |
| Reaction time | 2-3 hr |
| Trehalase assay range | 0.004-0.017 TNU(A)/ml |

TABLE 17

Color development

| | |
|---|---|
| Reaction mixture | 20 μl |
| Glucose oxidase reagent | 200 μl |
| Incubation temperature | 20° C. |
| Reaction time | 10-15 min |
| Wavelength | 490 nm |

Assay results showed that trehalase expression proportionally increased the glucose released, measured as the optical density at 490 nm (0.10 for background strain lacking the trehalase gene compared to 0.88 for the trehalase-expressing strain).

Example 6: Activity Assay of Yeast Strains Expressing Trehalase

Yeast strains from Example 4 were cultivated overnight in standard YPD media containing 2% or 6% glucose. The cultured yeast medium was subjected to centrifugation at 3500 rpm for 10 min to harvest the supernatant. The culture supernatant is used for the described enzyme activity assays. Yeast may also be cultivated using other cultivation media such as minimal YNB media or clarified and filtered industrial liquefied corn mash.

Glucoamylase activity was measured using maltose as substrate as described supra.

Trehalase activity was measured using trehalose as substrate. Enzyme hydrolysis of trehalose will release glucose as reaction product which may be detected using commercially available assay kits such as Wako Diagnostics AUTOKIT GLUCOSE C2. Reagents provided in the assay kits will specifically react with glucose resulted in color formation. The color intensity measured on spectrophotometer or microplate reader, is proportional to trehalase activity. Reaction conditions are described in Table 18. The Trehalase Unit (TNU) for standard trehalase is defined as the amount of enzyme, which hydrolyzes one micromole trehalose per minute under the standard conditions.

TABLE 18

Trehalase reaction conditions

| | |
|---|---|
| Appropriate amount of yeast supernatant | 10-200 μl |
| Substrate | trehalose, 10 mM |
| Buffer | acetate, 0.1M |
| pH | 5.0 ± 0.05 |
| Incubation temperature | 32° C. |
| Reaction time | 5-20 min |
| Trehalase assay range | 0.002-0.036 TNU/ml |

The absorbance at 505 nm increases as the amount of purified glucoamylase or trehalase added to hydrolyze maltose or trehalose, respectively, to glucose increases. A purified glucoamylase and trehalase standard curve was generated and used to estimate glucoamylase and trehalase activity in yeast supernatants.

Figure 2:
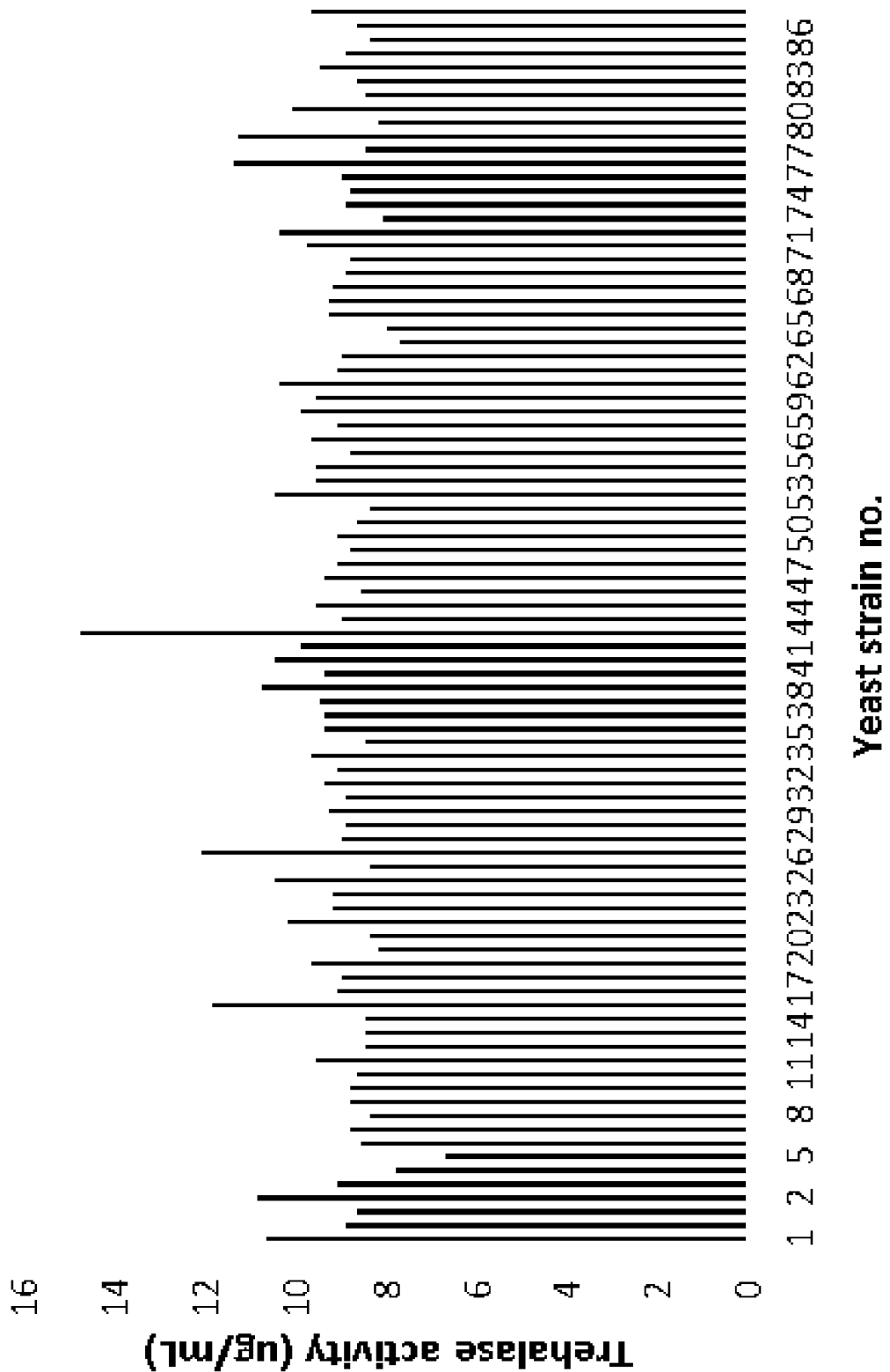
FIG. 2 shows trehalase activity for strains constructed in Example 4.

Results for trehalase activity and glucoamylase activity are shown Table 19. A graphical representation of comparative trehalase activity is shown in FIG. 2.

TABLE 19

Trehalase and glucoamylase (GA) activity, and estimated enzyme secretion.

| Yeast strain no. | Promoter for trehalase expression | SEQ ID NO: (mature polypeptide) | Donor Organism (catalytic domain) | Glucoamylase activity | Glucoamylase Conc. (ug/mL) | Trehalase activity | Trehalase Conc. (ug/mL) |
|---|---|---|---|---|---|---|---|
| 1 | Background strain with glucoamylase gene, without trehalase gene | | | 0.352 | 10.7 | N/A | N/A |
| 1 | Background strain with glucoamylase gene, without trehalase gene | | | 0.312 | 8.9 | N/A | N/A |
| 1 | Background strain with glucoamylase gene, without trehalase gene | | | 0.308 | 8.7 | N/A | N/A |
| 2 | pPGK1 | 189 | Acidobacteriaceae bacterium | 0.357 | 10.9 | 0.05 | 1.04 |
| 3 | pCCW12 | 191 | Acidovorax wautersii | 0.301 | 9.1 | 1.8 | 22.79 |
| 4 | pPGK1 | 218 | Acremonium curvulum | 0.287 | 7.8 | 0.07 | 1.08 |
| 5 | pCCW12 | 218 | Acremonium curvulum | 0.261 | 6.7 | 0.08 | 1.09 |

TABLE 19-continued

Trehalase and glucoamylase (GA) activity, and estimated enzyme secretion.

| Yeast strain no. | Promoter for trehalase expression | SEQ ID NO: (mature polypeptide) | Donor Organism (catalytic domain) | Glucoamylase activity | Conc. (ug/mL) | Trehalase activity | Conc. (ug/mL) |
|---|---|---|---|---|---|---|---|
| 6 | pCCW12 | 205 | Acremonium dichromosporum | 0.304 | 8.6 | 0.78 | 3.78 |
| 7 | pCCW12 | 205 | Acremonium dichromosporum | 0.309 | 8.8 | 0.89 | 4.63 |
| 8 | pCCW12 | 216 | Aspergillus cervinus | 0.299 | 8.4 | 0.12 | 1.18 |
| 9 | pPGK1 | 216 | Aspergillus cervinus | 0.309 | 8.8 | 0.13 | 1.2 |
| 10 | pPGK1 | 225 | Aspergillus niger | 0.308 | 8.8 | 0.48 | 2.22 |
| 11 | pCCW12 | 225 | Aspergillus niger | 0.307 | 8.7 | 0.67 | 3.11 |
| 12 | pPGK1 | 184 | Chaetomium jodhpurense | 0.327 | 9.6 | 0.15 | 1.26 |
| 13 | pCCW12 | 184 | Chaetomium jodhpurense | 0.302 | 8.5 | 1.77 | 21.85 |
| 14 | pCCW12 | 175 | Chaetomium megalocarpum | 0.302 | 8.5 | 1.77 | 21.85 |
| 15 | pCCW12 | 175 | Chaetomium megalocarpum | 0.303 | 8.5 | 0.4 | 1.95 |
| 16 | pPGK1 | 183 | Chaetomium nigricolor | 0.381 | 11.9 | 0.36 | 1.8 |
| 17 | pCCW12 | 183 | Chaetomium nigricolor | 0.315 | 9.1 | 0.66 | 3.05 |
| 18 | pCCW12 | 183 | Chaetomium nigricolor | 0.314 | 9 | 0.63 | 2.9 |
| 19 | pPGK1 | 182 | Chaetomium sp | 0.329 | 9.7 | 0.14 | 1.22 |
| 20 | pCCW12 | 182 | Chaetomium sp | 0.295 | 8.2 | 0.27 | 1.54 |
| 21 | pCCW12 | 182 | Chaetomium sp | 0.301 | 8.4 | 0.12 | 1.18 |
| 22 | pCCW12 | 201 | Chaetomium virescens | 0.341 | 10.2 | 0.53 | 2.43 |
| 23 | pPGK1 | 201 | Chaetomium virescens | 0.318 | 9.2 | 0.23 | 1.43 |
| 24 | pPGK1 | 187 | Chloridium virescens | 0.317 | 9.2 | 0.24 | 1.47 |
| 25 | pPGK1 | 187 | Chloridium virescens | 0.349 | 10.5 | 0.15 | 1.25 |
| 26 | pCCW12 | 211 | Dioszegia cryoxerica | 0.299 | 8.4 | 0.07 | 1.07 |
| 27 | pPGK1 | 211 | Dioszegia cryoxerica | 0.384 | 12.1 | 0.44 | 2.07 |
| 28 | pPGK1 | 177 | Doratomyces sp | 0.314 | 9 | 1.08 | 6.44 |
| 29 | pCCW12 | 177 | Doratomyces sp | 0.315 | 8.9 | 1.87 | 25.75 |
| 30 | pPGK1 | 194 | Enterobacter sp | 0.321 | 9.3 | 0.9 | 4.71 |
| 31 | pCCW12 | 194 | Enterobacter sp | 0.312 | 8.9 | 1.87 | 25.75 |
| 32 | pPGK1 | 206 | Fusarium sambucinum | 0.323 | 9.4 | 0.05 | 1.05 |
| 33 | pCCW12 | 188 | Gelasinospora cratophora | 0.315 | 9.1 | 0.66 | 3.05 |
| 34 | pCCW12 | 188 | Gelasinospora cratophora | 0.33 | 9.7 | 0.8 | 3.91 |
| 35 | pPGK1 | 213 | Hamigera avellanea | 0.302 | 8.5 | 0.63 | 2.89 |
| 36 | pCCW12 | 213 | Hamigera avellanea | 0.324 | 9.4 | 0.98 | 5.38 |
| 37 | pCCW12 | 213 | Hamigera avellanea | 0.322 | 9.4 | 1.13 | 6.97 |
| 38 | pPGK1 | 213 | Hamigera avellanea | 0.326 | 9.5 | 0.1 | 1.15 |
| 39 | pPGK1 | 193 | Kosakonia sacchari | 0.356 | 10.8 | 0.12 | 1.19 |
| 40 | pCCW12 | 193 | Kosakonia sacchari | 0.323 | 9.4 | 0.06 | 1.07 |
| 41 | pPGK1 | 176 | Lecanicillium psalliotae | 0.349 | 10.5 | 0.15 | 1.25 |
| 42 | pCCW12 | 176 | Lecanicillium psalliotae | 0.333 | 9.9 | 0.07 | 1.08 |
| 43 | pPGK1 | 176 | Lecanicillium psalliotae | 0.446 | 14.8 | 0.06 | 1.06 |
| 44 | pCCW12 | 208 | Lentinus similis | 0.314 | 9 | 0.05 | 1.05 |
| 45 | pPGK1 | 208 | Lentinus similis | 0.328 | 9.6 | 0.05 | 1.04 |
| 46 | pPGK1 | 204 | Moelleriella libera | 0.304 | 8.6 | 0.13 | 1.21 |
| 47 | pPGK1 | 198 | Corynascus sepedonium | 0.322 | 9.4 | 0.58 | 2.66 |

TABLE 19-continued

Trehalase and glucoamylase (GA) activity, and estimated enzyme secretion.

| Yeast strain no. | Promoter for trehalase expression | SEQ ID NO: (mature polypeptide) | Donor Organism (catalytic domain) | Glucoamylase activity | Conc. (ug/mL) | Trehalase activity | Conc. (ug/mL) |
|---|---|---|---|---|---|---|---|
| 48 | pCCW12 | 198 | Corynascus sepedonium | 0.316 | 9.1 | 1.13 | 6.98 |
| 49 | pCCW12 | 198 | Corynascus sepedonium | 0.31 | 8.8 | 1.2 | 7.9 |
| 50 | pCCW12 | 178 | Mucor moelleri | 0.316 | 9.1 | 0.34 | 1.75 |
| 51 | pPGK1 | 178 | Mucor moelleri | 0.305 | 8.7 | 0.78 | 3.77 |
| 52 | pCCW12 | 186 | Myceliophthora hinnulea | 0.299 | 8.4 | 0.99 | 5.51 |
| 53 | pPGK1 | 186 | Myceliophthora hinnulea | 0.348 | 10.5 | 0.38 | 1.85 |
| 54 | pPGK1 | 203 | Myceliophthora sepedonium | 0.328 | 9.6 | 0.43 | 2.04 |
| 55 | pPGK1 | 203 | Myceliophthora sepedonium | 0.328 | 9.6 | 0.41 | 1.97 |
| 56 | pCCW12 | 203 | Myceliophthora sepedonium | 0.31 | 8.8 | 1.2 | 7.9 |
| 57 | pPGK1 | 199 | Myceliophthora thermophila | 0.329 | 9.7 | 0.3 | 1.63 |
| 58 | pCCW12 | 199 | Myceliophthora thermophila | 0.315 | 9.1 | 0.74 | 3.54 |
| 59 | pPGK1 | 220 | Penicillium sp | 0.334 | 9.9 | 0.05 | 1.04 |
| 60 | pCCW12 | 220 | Penicillium sp | 0.326 | 9.6 | 0.05 | 1.04 |
| 61 | pPGK1 | 179 | Phialophora cyclaminis | 0.345 | 10.4 | 0.2 | 1.36 |
| 62 | pCCW12 | 179 | Phialophora cyclaminis | 0.315 | 9.1 | 0.66 | 3.05 |
| 63 | pPGK1 | 207 | Phoma sp | 0.312 | 9 | 0.07 | 1.09 |
| 64 | pCCW12 | 207 | Phoma sp | 0.283 | 7.7 | 0.09 | 1.12 |
| 65 | pCCW12 | 217 | Rasamsonia brevistipitata | 0.29 | 8 | 0.61 | 2.79 |
| 66 | pPGK1 | 217 | Rasamsonia brevistipitata | 0.321 | 9.3 | 0.54 | 2.46 |
| 67 | pCCW12 | 202 | Rhodothermus marinus | 0.319 | 9.3 | 0.3 | 1.61 |
| 68 | pPGK1 | 202 | Rhodothermus marinus | 0.318 | 9.2 | 0.12 | 1.18 |
| 69 | pPGK1 | 195 | Saitozyma flava | 0.312 | 8.9 | 0.25 | 1.48 |
| 70 | pCCW12 | 195 | Saitozyma flava | 0.309 | 8.8 | 0.39 | 1.9 |
| 71 | pCCW12 | 221 | Talaromyces aurantiacus | 0.332 | 9.8 | 0.6 | 2.77 |
| 72 | pPGK1 | 221 | Talaromyces aurantiacus | 0.345 | 10.4 | 0.57 | 2.63 |
| 73 | pCCW12 | 223 | Talaromyces leycettanus | 0.293 | 8.1 | 1.13 | 7.02 |
| 74 | pPGK1 | 223 | Talaromyces leycettanus | 0.311 | 8.9 | 0.71 | 3.35 |
| 75 | pPGK1 | 219 | Talaromyces piceae | 0.308 | 8.8 | 0.45 | 2.11 |
| 76 | pCCW12 | 219 | Talaromyces piceae | 0.313 | 9 | 0.73 | 3.48 |
| 77 | pCCW12 | 222 | Talaromyces pinophilus | 0.368 | 11.4 | 1.29 | 9.26 |
| 78 | pCCW12 | 222 | Talaromyces pinophilus | 0.302 | 8.5 | 0.95 | 5.13 |
| 79 | pPGK1 | 222 | Talaromyces pinophilus | 0.365 | 11.3 | 0.62 | 2.87 |
| 80 | pCCW12 | 224 | Talaromyces variabilis | 0.296 | 8.2 | 0.06 | 1.06 |
| 81 | pPGK1 | 181 | Thielavia antarctica | 0.338 | 10.1 | 0.08 | 1.1 |
| 82 | pCCW12 | 180 | Thielavia arenaria | 0.302 | 8.5 | 0.25 | 1.5 |
| 83 | pCCW12 | 215 | Trichoderma lixii | 0.306 | 8.7 | 0.06 | 1.06 |
| 84 | pPGK1 | 215 | Trichoderma lixii | 0.326 | 9.5 | 0.1 | 1.15 |
| 85 | pPGK1 | 200 | Trichoderma reesei GH37 | 0.312 | 8.9 | 0.05 | 1.04 |
| 86 | pCCW12 | 226 | Trichoderma reesei GH65 | 0.301 | 8.4 | 0.18 | 1.3 |
| 87 | pCCW12 | 192 | Xanthomonas arboricola | 0.306 | 8.7 | 0.46 | 2.17 |
| 88 | pPGK1 | 192 | Xanthomonas arboricola | 0.33 | 9.7 | 0.09 | 1.12 |

Example 7: Simultaneous Saccharification and Fermentation (SSF) of Yeast Strains Expressing Trehalase Simultaneous saccharification and fermentation (SSF) was performed via mini-scale fermentations for various trehalase-expressing strains described supra using industrial corn mash (Avantec® Amp, Novozymes, A/S). Yeast strains were cultivated overnight in YPD media with 2% glucose for 24 hours at 30° C. and 300 rpm. The corn mash was supplemented with 250 ppm of urea, dosed with 0.15 AGU/g-DS of an exogenous glucoamylase enzyme product (Spirizyme® Excel, Novozymes, A/S), and 30 mM trehalose. Approximately 0.6 mg of corn mash was dispensed per well to 96 well microtiter plates, followed by the addition of approximately 10^8 yeast cells/g of corn mash from the overnight culture. Plates were incubated at 32° C. without shaking. Duplicates of each strain were analyzed after 48 hour fermentations. Fermentation was conducted using the conditions shown in Table 20, and then stopped by the addition of 100 μL of 8% $H_2SO_4$, followed by centrifugation at 3000 rpm for 10 min. The supernatant was analyzed for trehalose using HPLC.

TABLE 20

Microtiter plate fermentation reaction conditions

| | |
|---|---|
| Substrate | Avantec ® Amp corn mash |
| Yeast pitch | 10^8 cells/g corn mash |
| Supplementary urea | 250 ppm |
| Supplementary trehalose | 30 mM |
| Exogenous glucoamylase product dose | 0.15 AGU/g-DS |
| PH | 5.0 ± 0.05 |
| Incubation temperature | 32° C. |
| Reaction time | 48 hours |

As shown in Table 21, higher reduction in trehalose was obtained from yeast expressing a heterologous trehalase compared to yeast lacking heterologous trehalase expression at 48 hours of simultaneous and saccharification fermentation (SSF).

TABLE 21

| Promoter | SEQ ID NO: (mature polypeptide) | Trehalase Donor Organism | Mean (trehalose % w/v) |
|---|---|---|---|
| Background strain with glucoamylase gene, without trehalase gene | | | 0.96 |
| pCCW12 | 191 | Acidovorax wautersii | 0.23 |
| pCCW12 | 218 | Acremonium curvulum | 0.29 |
| pCCW12 | 205 | Acremonium dichromosporum | 0.12 |
| pCCW12 | 216 | Aspergillus cervinus | 0.23 |
| pCCW12 | 225 | Aspergillus niger | 0.22 |
| pCCW12 | 184 | Chaetomium jodhpurense | 0.09 |
| pCCW12 | 175 | Chaetomium megalocarpum | 0.14 |
| pCCW12 | 183 | Chaetomium nigricolor | 0.12 |
| pCCW12 | 182 | Chaetomium sp | 0.19 |
| pCCW12 | 201 | Chaetomium virescens | 0.13 |
| pCCW12 | 21 | Dioszegia cryoxerica | 0.25 |
| pCCW12 | 177 | Doratomyces sp | 0.15 |
| pCCW12 | 194 | Enterobacter sp | 0.06 |
| pCCW12 | 188 | Gelasinospora cratophora | 0.12 |
| pCCW12 | 213 | Hamigera avellanea | 0.10 |
| pCCW12 | 193 | Kosakonia sacchari | 0.23 |
| pCCW12 | 176 | Lecanicillium psalliotae | 0.35 |
| pCCW12 | 208 | Lentinus similis | 0.43 |
| pCCW12 | 198 | Corynascus sepedonium | 0.13 |
| pCCW12 | 178 | Mucor moelleri | 0.13 |
| pCCW12 | 186 | Myceliophthora hinnulea | 0.14 |
| pCCW12 | 203 | Myceliophthora sepedonium | 0.13 |
| pCCW12 | 199 | Myceliophthora thermophila | 0.11 |
| pCCW12 | 220 | Penicillium sp | 0.95 |
| pCCW12 | 179 | Phialophora cyclaminis | 0.09 |
| pCCW12 | 207 | Phoma sp | 0.33 |
| pCCW12 | 217 | Rasamsonia brevistipitata | 0.16 |
| pCCW12 | 202 | Rhodothermus marinus | 0.42 |
| pCCW12 | 195 | Saitozyma flava | 0.19 |
| pCCW12 | 221 | Talaromyces aurantiacus | 0.15 |
| pCCW12 | 223 | Talaromyces leycettanus | 0.19 |
| pCCW12 | 219 | Talaromyces piceae | 0.19 |
| pCCW12 | 222 | Talaromyces pinophilus | 0.16 |
| pCCW12 | 224 | Talaromyces variabilis | 0.99 |
| pCCW12 | 180 | Thielavia arenaria | 0.11 |
| pCCW12 | 215 | Trichoderma lixii | 0.88 |
| pCCW12 | 226 | Trichoderma reesei GH65 | 0.27 |
| pCCW12 | 192 | Xanthomonas arboricola | 0.36 |
| pPGK1 | 189 | Acidobacteriaceae bacterium | 0.30 |
| pPGK1 | 218 | Acremonium curvulum | 0.40 |
| pPGK1 | 216 | Aspergillus cervinus | 0.29 |
| pPGK1 | 225 | Aspergillus niger | 0.11 |
| pPGK1 | 184 | Chaetomium jodhpurense | 0.17 |
| pPGK1 | 183 | Chaetomium nigricolor | 0.39 |
| pPGK1 | 182 | Chaetomium sp | 0.16 |
| pPGK1 | 201 | Chaetomium virescens | 0.17 |
| pPGK1 | 187 | Chloridium virescens | 0.20 |
| pPGK1 | 211 | Dioszegia cryoxerica | 0.15 |
| pPGK1 | 177 | Doratomyces sp | 0.19 |
| pPGK1 | 194 | Enterobacter sp | 0.18 |
| pPGK1 | 206 | Fusarium sambucinum | 0.26 |
| pPGK1 | 213 | Hamigera avellanea | 0.26 |
| pPGK1 | 193 | Kosakonia sacchari | 0.25 |
| pPGK1 | 176 | Lecanicillium psalliotae | 0.24 |
| pPGK1 | 208 | Lentinus similis | 0.15 |
| pPGK1 | 204 | Moelleriella libera | 0.18 |
| pPGK1 | 198 | Corynascus sepedonium | 0.18 |
| pPGK1 | 178 | Mucor moelleri | 0.20 |
| pPGK1 | 186 | Myceliophthora hinnulea | 0.17 |
| pPGK1 | 203 | Myceliophthora sepedonium | 0.16 |
| pPGK1 | 199 | Myceliophthora thermophila | 0.16 |
| pPGK1 | 220 | Penicillium sp | 1.19 |
| pPGK1 | 179 | Phialophora cyclaminis | 0.20 |
| pPGK1 | 207 | Phoma sp | 0.32 |
| pPGK1 | 217 | Rasamsonia brevistipitata | 0.11 |
| pPGK1 | 202 | Rhodothermus marinus | 0.44 |
| pPGK1 | 195 | Saitozyma flava | 0.19 |
| pPGK1 | 221 | Talaromyces aurantiacus | 0.16 |
| pPGK1 | 223 | Talaromyces leycettanus | 0.13 |
| pPGK1 | 219 | Talaromyces piceae | 0.20 |
| pPGK1 | 222 | Talaromyces pinophilus | 0.11 |
| pPGK1 | 181 | Thielavia antarctica | 0.25 |
| pPGK1 | 215 | Trichoderma lixii | 0.35 |
| pPGK1 | 200 | Trichoderma reesei GH37 | 0.42 |
| pPGK1 | 192 | Xanthomonas arboricola | 0.42 |

SEQUENCE LISTING (236 sequences)

SEQ ID NO: 1 - DNA, 621 bp, Saccharomyces cerevisiae
cagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtctt

SEQ ID NO: 2 - DNA, 644 bp, Saccharomyces cerevisiae
agctacctatattccaccataatatcaatcatgcggttgctggtgtatttaccaataatgtttaatgtatatatattaggggccgtatacttacatatagtagatgtcaagcgtaggcgcttcccctgccggctgtgacggcgccataaccaaggtatctatagaccgccaatcagcaaactacctccgtacattcatgttgcacccacacatgtacacacccagaccgcaacaaattacccataaggttgtttgtgacggcgtcgtacaagagaacgtgggaactttttaggctcaccaaaaaagaaaggaaaaatacgagttgctgacagaagcctcaagaaaaaaaaaattcttcttcgactatgctggaggcagagatgatcgagccggtagttaactatatatagctaaattggttccatcaccttcttttctggtgtcgctccttctagtgctatttctggcttttcctattttttttttttccatttttctttctctctttctaatatataaattctcttgcattttctatttttctctctatctattctacttgtttattcccttcaaggtttttttttaaggagtacttgtttttagaatatacggtcaacgaactataattaagctagaacaaa

SEQ ID NO: 3 - DNA, 457 bp, Saccharomyces cerevisiae
ctccagaaaggcaacgcaaaattttttttccagggaataaactttctatgacccactacttctcgtaggaacaatttcgggcccctgcgtgttcttctgaggttcatcttttacatttgcttctgctggataattttcagaggcaacaaggaaaaattagatggcaaaaagtcgtctttcaaggaaaaatccccaccatccttcgagatcccctgtaacttattggcaactgaaagaatgaaaaggaggaaaatacaaaatatactagaactgaaaaaaaaaagtataaatagagacgatatatgccaatacttcacaatgttcgaatccattcttcatttgcagctattgtaaaataataaaacatcaagaacaaacaagctcaacttgtcttttctaagaacaaagaataaacacaaaaacaaaaagtttttttaattttaatcgctagaacaaa

SEQ ID NO: 4 - DNA, 700 bp, Saccharomyces cerevisiae
gtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcatcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 5 - DNA, 705 bp, Sacharromyces cerevisiae
atccttttgttgtttccgggtgtacaatatggacttcctcttttctggcaaccaaacccatacatcgggattcctataataccttcgttggtctccctaacatgtaggtggcggaggggagatatacaatagaacagataccagacaagacataatgggctaaacaagactacaccaattacactgcctcattgatggtggtacataacgaactaatactgtagccctagacttgatagccatcatcatatcgaagtttcactaccctttttccatttgccatctattgaagtaataataggcgcatgcaacttcttttctttttttttcttttctctctcccccgttgttgtctcaccatatccgcaatgacaaaaaaatgatggaagacactaaaggaaaaaattaacgacaaagacagcaccaacagatgtcgttgttccagagctgatgaggggtatctcgaagcacacgaaactttttccttccttcattcacgcacactactctctaatgagcaacggtatacggccttccttccagttacttgaatttgaaataaaaaaaagtttgctgtcttgctatcaagtataaatagacctgcaattattaatcttttgtttcctcgtcattgttctcgttccctttcttccttgtttctttttctgcacaatatttcaagctataccaagcatacaatcaact

SEQ ID NO: 6 - DNA, 700 bp, Saccharomyces cerevisiae
aagaggatgtccaatattttttttaaggaataaggatacttcaagactagattcccccctgcattcccatcagaaccgtaaaccttggcgctttccttgggaagtattcaagaagtgccttgtccggtttctgtggctcacaaaccagcgcgcccgatatggctttcttttcacttatgaatgtaccagtacgggacaattagaacgctcctgtaacaatctctttgcaaatgtggggttacattctaaccatgtcacactgctgacgaaattcaaagtaaaaaaaaatgggaccacgtcttgagaacgatagattttctttattttacattgaacagtcgttgtctcagcgcgctttatgttttcattcatacttcatattataaaataacaaaagaagaatttcatattcacgcccaagaaatcaggctgctttccaaatgcaattgacacttcattagccatcacacaaaactctttcttgctggagcttcttttaaaaaagacctcagtacaccaaacacgttacccgacctcgttattttacgacaactatgataaaattctgaagaaaaaataaaaaaattttcatacttcttgcttttatttaaaccattgaatgatttcttttgaacaaaactacctgtttcaccaaaggaaatagaaagaaaaaatcaattagaagaaaacaaaaaacaaa

SEQ ID NO: 7 - protein, 19 aa, Saccharomyces cerevisiae
MRFPSIFTTVLFAASSALA

SEQ ID NO: 8 - protein, 556 aa, Gloeophyllum sepiarium
QSVDSYVSSEGPIAKAGVLANIGPNGSKASGASAGVVVASPSTSDPDYWYTWTRDSSLVFKSLIDQYTTGIDGTSSLRTLIDDFVTAEANLQQVSNPSGTLTTGGLGEPKFNVDETAFTGAWGRPQRDGPALRSTALITYGNWLLSNGNTSYVTSNLWPIIQNDLGYVVSYWNQSTYDLWEEVDSSSFFTTAVQHRALREGAAFATAIGQTSQVSSYTTQADNLLCFLQSYWNPSGGYITANTGGGRSGKDANTLLASIHTYDPSAGCDAATFQPCSDKALSNLKVYVDSFRSVYSINSGIASNAAVATGRYPEDSYQGGNPWYLTTFAVAEQLYDALNVWESQGSLEVTSTSLAFFQQFSSGVTAGTYSSSSSTYSTLTSAIKSFADGFVAVNAKYTPSNGGLAEQYSKSDGSPLSAVDLTWSYASALTAFEARNNTQFAGWGAAGLTVPSSCSGNSGGPTVAVTFNVNAETVWGENIYLTGSVDALENWSADNALLLSSANYPTWSITVNLPASTAIEYKYIRKNNGAVTWESDPNNSITTPASGSTTENDTWR

SEQ ID NO: 9 - protein, 374 aa, Aspergillus niger
APAPTRKGFTINQIARPANKTRTINLPGMYARSLAKFGGTVPQSVKEAASKGSAVTTPQNNDEEYLTPVTVGKSTLHLDFDTGSADLWVFSDELPSSEQTGHDLYTPSSSATKLSGYTWDISYGDGSSASGDVYRDTVTVGGVTTNKQAVEAASKISSEFVQNTANDGLLGLAFSSINTVQPKAQTTFFDTVKSQLDSPLFAVQLKHDAPGVYDFGYIDDSKYTGSITYTDADSSQGYWGFSTDGYSIGDGSSSSSGFSAIADTGTTLILLDDEIVSAYYEQVSGAQESEEAGGYVFSCSTNPPDFTVVIGDYKAVVPGKYINYAPISTGSSTCFGGIQSNSGLGLSILGDVFLKSQYVVFNSEGPKLGFAAQA

SEQ ID NO: 10 - protein, 590 aa, Trichoderma reesei
SVHLLESLEKLPHGWKAAETPSPSSQIVLQVALTQQNIDQLESRLAAVSTPTSSTYGKYLDVDEINSIFAPSDASSSAVESWLQSHGVTSYTKQGSSIWFQTNISTANAMLSTNFHTYSDLTGAKKVRTLKYSIPESLIGHVDLISPTTYFGTTKAMRKLKSSGVSPAADALAARQEPSSCKGTLVFEGETFNVFQPDCLRTEYSVDGYTPSVKSGSRIGFGSFLNESASFADQALFEKHFNIPSQNFSVVLINGGTDLPQPPSDANDGEANLDAQTILTIAHPLPITEFITAGSPPYFPDPVEPAGTPNENEPYLQYYEFLLSKSNAEIPQVITNSYGDEEQTVPRSYAVRVCNLIGLLGLRGISVLHSSGDEGVGASCVATNSTTPQFNPIFPATCPYVTSVGGTVSFNPEVAWAGSSGGFSYYFSRPWYQQEAVGTYLEKYVSAETKKYYGPYVDFSGRGFPDVAAHSVSPDYPVFQGGELTPSGGTSAASPVVAAIVALLNDARLREGKPTLGFLNPLIYLHASKGFTDITSGQSEGCNGNNTQTGSPLPGAGFIAGAHWNATKGWDPTTGFGVPNLKKLLALVRF

SEQ ID NO: 11 - protein, 511 aa, Thermoascus aurantiacus
VPVEVAGSAQGLDVTLSQVGNTRIKAVVKNTGSEDVTFVHLNFFKDAAPVQKVSLFRNATEVQFQGIKQRLITEGLSDDALTTLAPGATIEDEFDIASTSDLSEGGTITINSNGLVPITTDNKVTGYIPFTSNELSIDVDAAEAASVTQAVKILERRTRISSCSGSRQSALTTALRNAASLANKAADAAQSGSASKFSEYFKTTSSSTRQTVAARLRAVAREASSSSSGATTYYCLDPFGYCSGNVLAYTLPSYNIIANCPIFYTYLPPLTSTCHAQDQATTVLHEFTHAPGVYSPGTLDLAYGYQAAMGLSSSQAVMNADTYALYANAIYLGCTRISSCSGSRQSALTTALRNAASLANAAADAAQSGSASKFSEYFKTTSSSTRQTVAARLRAVAREASSSSSGATTYYCDDPYGYCSSNVLAYTLPSYNIIANCDIFYTYLPALTSTCHAQDQATTALHEFTHAPGVYSPGTDDLAYGYQAAMGLSSSQAVMNADTYALYANAIYLGC

SEQ ID NO: 12 - protein, 550 aa, Dichomitus squalens
KPTARNLKLHESRPSAPNGFSLVGSADSNRTLKLRLALAESNFSELERKLYDVSTPKSANYGKHLSKAEVQQLVAPGQDSIDAVNAWLKENDITAKTISSTGEWISFEVPVSKANDLFDADFSVFKHDDTGVEAIRTLSYSIPAELQGHLDLVHPTVTFPNPYSHLPVFQSPVKKTAEIQNFTAGAIPSSCSSTITPACLQAIYNIPTTAATESSNQLGVTGFIDQYANKKDLKTFLKKYRTDISSSTTFTLQTLDGGSNSQTGSKAGVEANLDIQYTVGVATGVPTTFISVGDDFQDGDLEGFLDVINALLDEDAPPSVLTTSYGQDESTISRALAVKLCNAYAQLGARGVSILFASGDGGVSGSQSASCSKFVPTFPSGCPYMTSVGATQGVNPETAADFSSGGFSNYWGVPDYQSDAVSTYLSALGKTNSGKYNASGRGFPDVSTQGVSFEVVVDGSVEAVDGTSCASPTFASIISLVNDKLVAAGKSPLGFLNPFLYSDGVAALNDITSGSNPGCNTNGFPAKKGWDPVTGLGTPDFKKLLTAVGL

SEQ ID NO: 13 - protein, 353 aa, Nocardiopsis prasina
ATGALPQSPTPEADAVSMQEALQRDLDLTSAEAEELLAAQDTAFEVDEAAAEAAGDAYGGSVFDTESLELTVLVTDAAAVEAVEATGAGTELVSYGIDGLDEIVQELNAADAVPGVVGWYPDVAGDTVVLEVLEGSGADVSGLLADAGVDASAVEVTTSDQPELYADIIGGLAYTMGGRCSVGFAATNAAGQPGFVTAGHCGRVGTQVTIGNGRGVFEQSVFPGNDAAFVRGTSNFTLTNLVSRYNTGGYATVAGHNQAPIGSSVCRSGSTTGWHCGTIQARGQSVSYPEGTVTNMTRTTVCAEPGDSGGSYISGTQAQGVTSGGSGNCRTGGTTFYQEVTPMVNSWGVRLRT

SEQ ID NO: 14 - protein, 456 aa, Penicillium simplicissimum
APASTAKDSVSSVVKNGVKYTVFEHAATGAKMEFVKNSGICETTPGVNQYSGYLSVGSNMNMWFWFFEARNNPQQAPLAAWFNGGPGCSSMIGLFQENGPCHFVNGDSTPSLNEYSWNNYANMLYVDQPIGVGFSYGTDDVTSTVTAAPYVWKLLQAFYAQFPEYESRDFAIFTESYGGHYGPEFASYIQEQNSAIKTGSISGENINLVALGVNNGWIDSTIQEKAYIDFSYNNSYQQLIDDSQRTSLLSAYNSQCLPAIQKCTKSGSNSDCQNADSVCYNKIEGPISSSGDWDVYDIREPSNDPYPPSTYSTYLSNADVVKAIGAQSSYQECPNGPYNKFASTGDNPRSFLSTLSSVVKSGINVLVWAGDADWICNWLGNYEVANAVDFSGHTEFSAKDLAPYTVNGTEKGMFKNVANFSFLKVYGAGHEVPYYQPDTALQVFEQVLQNKPIFST

SEQ ID NO: 15 - protein, 502 aa, Aspergillus niger
LQNPHRRAVPPPLSHRSVASRSVPVERRTTDFEYLTNKTARFLVNGTSIPEVDFDVGESYAGLLPNTPTGNSSLFFWFFPSQNPEASDEITIWLNGGPGCSSLDGLLQENGPFLWQPGTYKPVPNPYSWTNLTNVVYIDQPAGTGFSPGPSTVNNEEDVAAQFNSWFKHFVDTFDLHGRKVYITGESYAGMYVPYIADAMLNEEDTTYFNLKGIQINDPSINSDSVMMYSPAVRHLNHYNNIFQLNSTFLSYINAKADKCGYNAFLDKAITYPPPSPFPTAPEITEDCQVWDEVVMAAYDINPCFNYYHLIDFCPYLWDVLGFPSLASGPNNYFNRSDVQKILHVPPTDYSVCSETVIFANGDGSDPSSWGPLPSVIERTNNTIIGHGWLDYLLFLNGSLATIQNMTWNGKQGFQRPPVEPLFVPYHYGLAELYWGDEPDPYNLDAGAGYLGTAHTERGLTFSSVYLSGHEIPQYVPGAAYRQLEFLLGRISSLSAKGNYTS

SEQ ID NO: 16 - protein, 547 aa, Meriphilus giganteus
TPTGRNLKLHEAREDLPAGFSLRGAASPDTTLKLRIALVQNNFAELEDKLYDVSTPSSANYGNHLSKEEVEQYIAPAPESVKAVNAWLTENGLDAHTISPAGDWLAFEVPVSKANELFDADFSVFTHDESGLEAIRTLAYSIPAELQGHLDLVHPTVTFPNPNAHLPVVRSTQPIRNLTGRAIPASCASTITPACLQAIYGIPTTKATQSSNKLAVSGFIDQFANKADLKSFLAQFRKDISSSTTFSLQTLDGGENDQSPSEAGIEANLDIQYTVGLATGVPTTFISVGDDFQDGNLEGFLDIINFLLGESNPPQVLTTSYGQNENTISAKLANQLCNAYAQLGARGTSILFASGDGGVSGSQSAHCSNFVPTFPSGCPFMTSVGATQGVSPETAAAFSSGGFSNVFGIPSYQASAVSGYLSALGSTNSGKFNRSGRGFPDVSTQGVDFQIVSGGQTIGVDGTSCASPTFASVISLVNDRLIAAGKSPLGFLNPFLYSSAGKAALNDVTSGSNPGCSTNGFPAKAGWDPVTGLGTPNFAKLLTAVGL

SEQ ID NO: 17 - protein, 541 aa, Lecanicillium sp.
APAPHGPLVKFGEITKLPSKWIATGAADSDAVIKAQIGIKQNNIKGLQDKLADIADPNSPNYGQWLSKEEVDKYSAPAAADVAAVKAWLASSGITDVTMPTNDWIEFSVPVSKMESLLGSKYEWFVHLETGEKVPRTKQFSVPQNLHDLIDVVTPTTVLYHNMGPHAHASPQAADASGLTSPASIKSAYNVDYKGTGNTLVGTTGFLGVGASHQDYANFARQFSPGLTDFKDVSINGGSNSGDGSALEGNLDTQYCGALAAPNPSEYLAHAPEGSDGSSFNDAMLAFGNYLNANSNPPSAVSTSYGGEEDGTDPNYMDRICNEFMKAGSRGVSIFFSSGDNGVGGNGESSCYNGYYPLWPASCPYVTTVGGTEFDGSGREVVANFEQYNKNVKSPGGGFSNHFPAPSYNKNVTTAYANSLSAAQKQRLNPNGRGFPDIALVSVKYQVNVNGQISQVLGTSASSPSMAGLVGLLNDYRKTQGKPNLGFINPLLYSDKVKPALRDVTSGANKGCDSSGLPAKTGWDAASGLGSFDFAKLRTLV

SEQ ID NO: 18 - protein, 633 aa, Talaromyces proteolyticus
VPAPSKRHVVHERRDALPHSWSEPRRVDGRTQLPVRIGLTQSNIDESHDMLMDIASPSSPNYRKYMTVHEVNELFAPAGEAVSAVRDWLESAGIAAERVTQSANKQWLQFDGDAAEVESLLGAEYYIYTHDTNGRSHMGCEKYHVPEHISHHIDYIIPGVKSLEVREPQPAELEKRTFGFRKPQPPLFKALPESLETIINSILGGLLDLCSTVITPSCIKTLYNITEGTTATKGNELGIFEDLGDYYSQTDLDLFFTLFYSQIPAGTGPTLKGIDGAQAPTQTLTQAGPESDLDFQVSYPIIWPQNSILFQTDDANYEANYTFNGFLNNFLDAIDGSYCTYSAFGIDGNTADDPPYPDPASNGYKGSLQCGVYEPTNVISISYGGDEAGLSVNYQKRQCNEYKKLGLQGVSVVVSSGDSGVAGADGCLGGGKIFNPDFPAGCPYITTVGATYLPSGASSTSDSEVAVSRFPSGGGFSNIYSQPSYQSDAVNTYLTQHTPPYPAYETSDNSSVGANGGIYNKAGRGYPDVAAVGDNIVIFNAGAPTLIGGTSASAPIFASILTRINEVLLAKKGTTVGFVNPTLYANPDAFHDITSGDNPGCSTNGFSTAPGWDPVTGLGTPNYPALLKVFLGE

SEQ ID NO: 19 - protein, 371 aa, Penicillium ranomafanaense
VPTGGKKSFTVNQVAVSATKTQNFANNYARALAKYGAKVPTHVQAAAQQSGSATTTPESDDEEYLTPVNVGGTTLNLDFDTGSADLWVFSSELPASEQTGHSLYKPNNGTKLSGYTWSISYGDGSSASGDVYRDTVSVGGVKATGQAVEAASTISQQFTQDQNNDGLLGLAFSSINTVKPKSQTTFFDTVKSTLASPLFAVSLKHNAPGSYDFGFIDKSKYTGSLTYTDVDSSQGFWGFTADSYKIGSTTGSSIKGIADTGTTLLLLDDEVVSAYYKQVSGAASDSSAGGYTFDCSSTLPDFTVSISGYDAVVPGSLINYTPVSQGSSKCLGGIQSNSGLGFSIFGDIFLKSQYVVFDSNGPRLGFAAQSS

SEQ ID NO: 20 - protein, 578 aa, Aspergillus oryzae
EAFEKLSAVPKGWHYSSTPKGNTEVCLKIALAQKDAAGFEKTVLEMSDPDHPSYGQHFTTHDEMKRMLLPRDDTVDAVRQWLENGGVTDFTQDADWINFCTTVDTANKLLNAQFKWYVSDVKHIRRLRTLQYDVPESVTPHINTIQPTTRFGKISPKKAVTHSKPSQLDVTALAAAVVAKNISHCDSIITPTCLKELYNIGDYQADANSGSKIAFASYLEEYARYADLENFENYLAPWAKGQNFSVTTFNGGLNDQNSSSDSGEANLDLQYILGVSAPLPVTEFSTGGRGPLVPDLTQPDPNSNSNEPYLEFFQNVLKLDQKDLPQVISTSYGENEQEIPEKYARTVCNLIAQLGSRGVSVLFSSGDSGVGEGCMTNDGTNRTHFPPQFPAACPWVTSVGATFKTTPERGTYFSSGGFSDYWPRPEWQDEAVSSYLETIGDTFKGLYNSSGRAFPDVAAQGMNFAVYDKGTLGEFDGTSASAPAFSAVIALLNDARLRAGKPTLGFLNPWLYKTGRQGLQDITLGASIGCTGRARFGGAPDGGPVVPYASWNATQGWDPVTGLGTPDFAELKKLALGN

SEQ ID NO: 21 - protein, 456 aa, Talaromyces liani
APASTTKDNVSSVVKNGVTYTVFEHAATGAKMEFVKNSGICETTPGVNQYSGYLSVGNNMNMWFWFFEARNNPQTAPLAAWFNGGPGCSSMIGLFQENGPCHFVNGASTPSLNEYSWNNYANMLYVDQPIGVGFSYGTDDVTSTVTAAPYVWKLLQAFYAQFPEYQSRDFAIFTESYGGHYGPEFAAYIQEQNSGIAAGSVSGENINLIALGVNNGWIDPAIQEKAYIDFSYNNSYQQLIDDSQRTNLLSDYNDQCLPAIQQCAQTGRNSDCQNADNVCYDTIEGPISSSGNWDVYDIREPSNDPYPPSTYSSYLSNSRVVKAIGAQTSYQECPNGPYNKFASTGDNPRSFLSTLSSVVQSGIHVLVWAGDADWICNWLGNYRVANAVDFPGHAEFSAKALAPYTVNGTEKGMFKNVDNFSFLKVYGAGHEVPYYQPATALQVFEQILQNKSITST

SEQ ID NO: 22 - protein, 589 aa, Thermoascus thermophilus
EVFERLRAVPEGWRFSATPSDDQPIRLQIALQQHDVEGFERAVLDMSTPSSPNYGKHFQSHDEMKRMLLPSDDAVDAVLDWLQSAGITDIEEDADWINFRTTVGVANELLDTQFQWFVSETSSHVRRLRALEYSIPESVTPHIHMVQPTTRFGQIGRHHTTSREKPIVSGADIHASIAGANNQTTGTDCNTEITPKCLQDLYKFGGYKASANSGSKVGFCSYLEEYARYDDLALFEEALAPYAAGQNFSVITYNGGLNDQHSSSDSGEANLDLQYIVGVSAPLPVTEFSTGGRGELVPDLDQPNPADNSNEPYLDFLQNVLKLDQKDLPQVISTSYGENEQSVPEKYARSVCNLFMQLGSRGVSVIFSSGDSGVGSACLTNDGKNQTRFMPQFPASCPWVTSVGSTQHIAPEEATYFSSGGFSDLWPMPDYQKSAVGEYLDRLGSKWAGLYNPQGRGFPDVAAQGVNFNVYDKGSLKRFDGTSCSAPTFAGVIALLNDARLRARQPPMGFLNPWLYGAGKGGLNDIVNGGSTGCDGNARFGGAPNGSPVVPFASWNATQGWDPVSGLGTPDFSRLLKLAVPSRVGGRLA

SEQ ID NO: 23 - protein, 413 aa, Pyrococcus furiosus
AELEGLDESAAQVMATYVWNLGYDGSGITIGIIDTGIDASHPDLQGKVIGWVDFVNGRSYPYDDHGHGTHVASIAAGTGAASNGKYKGMAPGAKLAGIKVLGADGSGSISTIIKGVEWAVDNKDKYGIKVINLSLGSSQSSDGTDALSQAVNAAWDAGLVVVVAAGNSGPNKYTIGSPAAASKVITVGAVDKYDVITSFSSRGPTADGRLKPEVVAPGNWIIAARASGTSMGQPINDYYTAAPGTSMATPHVAGIAALLLQAHPSWTPDKVKTALIETADIVKPDEIADIAYGAGRVNAYKAINYDNYAKLVFTGYVANKGSQTHQFVISGASFVTATLYWDNANSDLDLYLYDPNGNQVDYSYTAYYDFEKVGYYNPTDGTWTIKVVSYSGSANYQVDVVSDGSLSQPGSSP

SEQ ID NO: 24 - protein, 387 aa, Trichoderma reesei
LPTEGQKTASVEVQYNKNYVPHGPTALFKAKRKYGAPISDNLKSLVAARQAKQALAKRQTGSAPNHPSDSADSEYITSVSIGTPAQVLPLDFDTGSSDLWVFSSETPKSSATGHAIYTPSKSSTSKKVSGASWSISYGDGSSSSGDVYTDKVTIGGFSVNTQGVESATRVSTEFVQDTVISGLVGLAFDSGNQVRPHPQKTWFSNAASSLAEPLFTADLRHGQNGSYNFGYIDTSVAKGPVAYTPVDNSQGFWEFTASGYSVGGGKLNRNSIDGIADTGTTLLLLDDNVVDAYYANVQSAQYDNQQEGVVFDCDEDLPSFSFGVGSSTITIPGDLLNLTPLEEGSSTCFGGLQSSSGIGINIFGDVALKAALVVFDLGNERLGWAQK

SEQ ID NO: 25 - protein, 408 aa, Rhizomucor miehei
RPVSKQSESKDKLLALPLTSVSRKFSQTKFGQQQLAEKLAGLKPFSEAAADGSVDTPGYYDFDLEEYAIPVSIGTPGQDFLLLFDTGSSDTWVPHKGCTKSEGCVGSRFFDPSASSTFKATNYNLNITYGTGGANGLYFEDSIAIGDITVTKQILAYVDNVRGPTAEQSPNADIFLDGLFGAAYPDNTAMEAEYGSTYNTVHVNLYKQGLISSPLFSVYMNTNSGTGEVVFGGVNNTLLGGDIAYTDVMSRYGGYYFWDAPVTGITVDGSAAVRFSRPQAFTIDTGTNFFIMPSSAASKIVKAALPDATETQQGWVVPCASYQNSKSTISIVMQKSGSSSDTIEISVPVSKMLLPVDQSNETCMFIILPDGGNQYIVGNLFLRFFVNVYDFGNNRIGFAPLASAYENE

SEQ ID NO: 26 - protein, 548 aa, Lenzites betulinus
KPMGRNLKVHEAREEIPDGFSLQGSAAPDTTLKLRIALVQSNFAELEQKLYDVSTPSSPNYGAHLSKEEVEQLVAPSADSVDAVNAWLKENDLSAQTISPAGDWLAFEVPVSKANELFDADFSVFTHDQTGLEAIRTMSYSIPAELQGHLDLVHPTVTFPNPYSHLPVVRSPIKASQNLTSRATIPASCASTITPACLQDIYGIPTTKATQSSNKLAVSGFIDQFANSADLATFLKKFRTDISSTTTFALQTLDGGSNSQSGSQAGVEANLDIQYTVGLASGVPVTFISVGDNFQDGDLEGFLDIINFLLAESAPPQVLTTSYGQNENTISVKLANQLCNAYAQLGARGTSILFASGDGGVSGSQSSSCSKFVPTFPSGCPFMTSVGATQGVNPETAADFSSGGFSNYFGIPSYQATAVKTYLTALGTTNSGKFNTSGRAFPDVSTQGVDFEIVVDGRTEGVDGTSCASPTFAAIISLVNDKLIAAGKSPLGFLNPFLYSTGASAFTDITSGSNPGCNTKGFPAKAGWDPVTGLGTPNFAKLLAAAGV

SEQ ID NO: 27 - protein, 547 aa, Neolentinus lepideus
GPAPRNLVLHESRDGVPEGFVKSSTASPDTTLKLRIALVQGDMASLEKALYDVSVPSSPLYGQHLSKQEVEEYVKPTQESVDAVNQWLSSEGITANTISPAGDWLQFSVPVSKANEMFDADFSVFTHTESGQQAIRTLSYSIPKELVGHLDLVHPTITFPNPYSHLPVVSSPAPRNLTIDASVPSSCGSTITPTCLQDLYGIPTTAATQSSNKLAVSGFIDQYANKADLKSFLTTYRKDISSSTTFTLETIDGGENPQDGSDAGVEANLDTQYTVGLATGVPTYFISVGDDYQDGDLEGFLDIVNYLLSMDQPQQVLTTSYGQNENTMSRSLANNLCNAYMQLGARGTSILFASGDGGVSGSQSGSCGSKFVPTFPSGCPYLTSVGATTGINPEVAASFSSGGFSNYWGVPSYQQSVVSSYISGLGSTNKGKYNSSGRGFPDVSAQGENVEIVVDGSTEGVDGTSCSSPIFASIVSLLNDELIAAGKSPLGFLNPFLYSDGASAFNDITSGDNPGCNTNGFSAKSGWDPVTGLGTPNYAKLRTAVGF

SEQ ID NO: 28 - protein, 399 aa, Thermococcus sp.
VSAEKVRVIITIDKDFNENSVFALGGNVVARGKVFPIVIAELSPRAVERLKNAKGVVRVEYDAEVQVLKGKSPGAGKPKPSQPAQTIPWGIERIKAPDVWSITDGSSSGVIEVAILDTGIDYDHPDLAANLAWGVSVLRGKVSTKPKDYKDQNGHGTHVAGTVAALNNDIGVVGVAPAVEIYAVRVLDASGRGSYSDIILGIEQALLGPDGVLDSDGDGIIVGDPDDDAAEVISMSLGGLSDVQAFHDAIIEAYNYGVVIVAASGNEGASSPSYPAAYPEVIAVGATDVNDQVPWWSNRGVEVSAPGVDVLSTYPDDSYETLSGTSMATPHVSGVVALIQAAYYNKYGSVLPVGTFDDNTMSTVRGILHITADDLGSSGWDADYGYGIVRADLAVQAVN

SEQ ID NO: 29 - protein, 396 aa, Thermococcus sp.
EKVRVIITIDKDFNENSVFALGGNVVARGKVFPIVIAELSPRAVERLKNAKGVVRVEYDAEVQVLKGKSPGAGKPKPSQPAQTIPWGIERIKAPDVWSITDGSSSGVIEVAILDTGIDYDHPDLAANLAWGVSVLRGKVSTKPKDYKDQNGHGTHVAGTVAALNNDIGVVGVAPAVEIYAVRVLDASGRGSYSDIILGIEQALLGPDGVLDSDGDGIIVGDPDDDAAEVISMSLGGLSDVQAFHDAIIEAYNYGVVIVAASGNEGASSPSYPAAYPEVIAVGATDVNDQVPWWSNRGVEVSAPGVDVLSTYPDDSYETLSGTSMATPHVSGVVALIQAAYYNKYGSVLPVGTFDDNTMSTVRGILHITADDLGSSGWDADYGYGIVRADLAVQAVN

SEQ ID NO: 30 - protein, 572 aa, Thermomyces lanuginosus
APFQVVERLSAPPDGWIKKEKAAPSAQIQFRLGLPQQNSEQLEQLALNIATPGHELYRKHLKRDEIKALVRPLASVSEKVLAWLRDEGVPEDRIHDDGAWIKFTVPVSTAEKLLNTEFFVFHNERTGAEQIRTLEYSVPQDIHSLVKFIQPTTHFSSLGPQVRRVVPLDVLPKLRITLEDCNKKITPDCLKQLYKIGDYVAPEDPRNRIGISGYLEQFARYADFEEFLESYAPDRTDANFTVVSINGGRNDQNSTLDSTEASLDIDYAVTLSYKTQAVYYTTAGRGPLVPDESQPDPNEVSNEPYMEQLQFLLDLPDEELPTVLTTSYGENEQSLPGSYADETCNMFRLLGMRGVSVIFSSGDWGTGIVCKANDGSERIKFDPVYPASCPYVTSVGGTTGVNPERAVEFSSGGFSDRFPRPKYQDEAVRSYLTKLGDHWKGLYNESGRAFPDVAAQADNFVVRDQGQWVSVGGTSASAPVFAAIIANVNAELLKAGKPPLGFLNPWLYGLKGRGFTDVVHGGSTGCPGTVPWTGLPAGHVPYASWNATEGWDPVTGLGTPLYDELVKAALGK

SEQ ID NO: 31 - protein, 397 aa, Thermococcus thioreducens
EKPELVRVIVHVDRGHFNTADVATIGGHVVYQFKLIDAVVVEVPSTAVGRLKKLPGVKMVEFDHKARILAGPPSWLGGGQPSQQIPWGISRVRAPDVWGITDGSGGVIEVAVLDTGVDYDHPDLAGNIAWCVSTLRGRVTTNPAQCKDQNGHGTHVIGTIAALNNDIGVVGVAPGVEIYSIRVLDASGSGSYSDIAIGIEQALLGPDGILDKDGDGIIVGDPDDDAAEVISMSLGGPTDDQYLHDMIITAYNYGVVIVAASGNEGASSPSYPAAYPEVIAVGASDVNDQIASWSNRQPEVSAPGVDILSTYPDDTYETLSGTSMATPHVSGVVALIQAAYYNKYGKVLPVGTFDDMGTNTVRGILHVTADDLGDAGWDIYYGYGIVRADLAVQAAIG

SEQ ID NO: 32 - protein, 549 aa, Polyporus arcularius
KPMARSMKLHESREGIPEGFSLRGAAQPEQTIKLRLALVQSNFAELERKLMDVSTPSSANYGKHLSKAEVQQLVAPTQDSVDAVKSWLKENDISAKTISATGDWLSFEVPVSKANELFDADFSIYTHDETGTEAVRTLSYSIPAELQGHLDLVHPTVTFPNPRGLPPVFTAPIKAEAQNLTSRATIPSSCARTITPACLQAIYNIPSTPATESSNKLAVTGFIEQFANKADLKTFLTRFRTDISSSTSFTLQTLDGGSNPQSSSEAGVEANLDIQYTVGVATGVPTVFISVGEDFQDGDLEGFLDVVNSLLDEDTPPFVMTTSYGQNENTISRNLANNLCNAYAQLGARGVSILFASGDGGVAGSQSASCSKFVPTFPSGCPFMTSVGATQGFSPETAADFSSGGFSNYFAIPDYQTSAVSGYIKALGNTNSGKYNATGRGFPDIATQGVNFEVVVGGQSGTVEGTSCSSPTLASIISLLNDRLIAAGKSPLGFLNPFLYSTGTSALNDITSGSNPGCNTNGFPAKAGWDPVTGLGTPDFNKLLSAVGL

SEQ ID NO: 33 - protein, 548 aa, Ganoderma lucidum
KSTTRNLKLHETRQGAPSGFSHTGSADPNQTLKLRLALVQGNTAELERKLYDVSTPSSANYGKHLSKEEVRQLVAPAQGSVDAVNAWLRENGITAKSTSAAGDWLSFEVPVSKANELFDADFSVFKHDDTGVKAVRTLSYSIPAELQGHLDLVHPTVTFPNPNGHMPVFQAPVKDTDAVQNFSARAVPSSCSNTITPACLQALYNIPSDAATQSSNKLAVTGFIEQYANQVDLAVFLKQYRADISSNTTFALQTLDGGSNSQTNVPGVEANLDIQYTVGIATGVPTVFISVGDQYQDGDLEGFLDVINFLLDEDTPPYVVTTSYGQDEHTISRKLAQNLCNAYAQLGARGVSILFASGDGGVAGSRSNSCSKFVPTFPSGCPYMTSVGATQGVPETAADFSSGGFSNYFGTPDYQASAVKSYLSTLGSTNRGKFNASGRGFPDVATQGVNFEVIVDGEVEGVSGTSAASPMFAAIVALLNDKLIAAGKSPLGFLNPFLYSKGVEALNDITTGSNPGCGTIGFPAKEGWDPVTGLGTPDFQKLASAAGL

SEQ ID NO: 34 - protein, 548 aa, Ganoderma lucidum
KTATRNLKLHETSQGAPSGFSLTGSADPDQTLKLRLALVQGNVAELERRLYDVSTPSSPNYGKHLSKSEVQQLVAPAQDSIDAINAWLKENGISAKTTSATGDWLSFEVPVSKANELFDADFSVYKHHDTGMEVVRTLSYSIPAELQAHLDLVHPTVTFPNPKGHPPVFQAPAMITNDVQNFSAGAVPSSCSSRITPACLQALYNIPSDPATQPSNKLAVTGYIEQYANQDDLAVFLKEYRADMSSNTTFTLQTLDGGVNSQTDEAGIEANLDVQYTVGIATGVPTVFISVGDQYQDGNLEGFLDVVNFLLDEDTPPYVMTTSYGQDEHTMSRKLAQNLCNAYAQLGARGVSILFASGDGGVAGSRSSSCSKFVPTFPSGCPYMTSVGATQGVPETAADFSSGGFSNYFGIPDYQASAVSGYLSALGHTNKGKYNASGRGFPDVSTQGVNFEVMVDGALEGVSGTSAASPTFAAVVALLNDRLIAAGKSPLGFLNPFLYSKGVSALNDITSGSNPGCRTNGFPAKEGWDPVTGLGTPDFQKLASAAGL

SEQ ID NO: 35 - protein, 541 aa, Ganoderma lucidum
KPTARNLRLHETRQGAPSGFSLTGSADPNQTVRLRLALVQGNTGELERKLYDVSTPSSANYGKHLSKAEVQQLVAPAQGSIDAVNAWLKENDITAKTISATGDWLSFEVPVNKANELFDADFSVFKHDDTGMEAVRTLSYSIPAELQGHLDLVHPTVTFPNPKGNLPLFQTPIKSKRDVPADCSNNITPACLQALYNIPSDAATQSSNTLAVTGYIEQYANQQDLTSFLGQFRPDISSNTTFALQTIDGGSNSQNGSDAGGEANLDIQYTVGLATGVPTVFISVGEQYQDGDLGGLLDVINFVLAEDAPPNVITTSYGQNENTISLKLAQNLCNAYAQLGARGVSILFASGDGGVAGSQSDNCTQFVPTFPSGCPYMTSVGATQGVPETAADFSTGGFSNLFSVPDYQAAAVQSYLSALGGTYQGLFNASGRAFPDVSTQGVNFETVVDGSVSGASGTSAASPTFAAIVALLNDRLVAAGKSPLGFLNPFLYSTGASALNDIATGSNPGCGTNGFSAQKGWDPVTGLGTPDFQKLAAAAGL

SEQ ID NO: 36 - protein, 547 aa, Trametes sp.
TPTGRNLKLHEAREDIPTGYSLRGAASPDTTLKLRLALVQNNFAELEDKLYDVSTPSSANYGNHLSKEEVEQYIAPAPESVKAVNAWLTENGLDAHTISPAGDWLAFEVPVSKANELFDADFSVFTHDESGLEAIRTLAYSIPAELQGHLDLVHPTVTFPNPNAHLPVVRSTKPIQNLTGRAIPASCASTITPACLQAIYGIPTTKATQSSNKLAVSGFIDQFANSADLKSFLSTFRKDISSSTTFALQTLDGGQNNQSPSQAGIEANLDIQYTVGLATGVPVTFISVGDNFQDGDLEGFLDIINFLLSESNPPQVLTTSYGQNENTISAKLANQLCNAYAQLGARGTSILFASGDGGVAGSQSSSCRNFVPTFPSGCPFMTSVGATQGVSPETAADFSSGGFSNVFGIPSYQTSAVSGYLSALGNTNSGKFNRSGRGFPDVATQGVNFQIVSGGDTGGVDGTSCASPTFASVISLINDRLIAAGKSPLGFLNPFLYSAAGKAALNDVTSGSNPGCNTNGFPAKAGWDPVTGLGTPNFAKLLTAVGL

SEQ ID NO: 37 - protein, 553 aa, Cinereomyces lindbladii
KPTARNLLVHESLDGVPTGFQLVGPASPDTVLSMRIALVQSDPAGLEAALYDVSTPSSASYGNHLSKAEVEKFVSPTSESVQAVNAWLTENDLTATQLSPAGDWLGFEVPVSKAEDLFGTQFSVFTHEATGMQTVRTLSYSIPSELQGHLDLVFPTINFPDPNANLPVFRHASKKREVTTLNANLTSDAVPSSCADTITPACLQALYGIPTTPATSSTNQLGVSGFIDQFANQADLKTFLQNFRTDISSSTTFSLETLDGGSNSQNRGDAGVEANLDTQYTVGLATDVPTVFISVGEDNQDGSLGGFLDIINFLLDQDSPPQVLTTSYGQNENTVSRAVANNLCNAYAQLGARGTSILFASGDGGVSGSQSASCRTFVPTFPSGCPFMTSVGATTGINPETAATFSAGGFSNYFGTPSYQASAVSSYLAALGSTNSGKFNTSGRGYPDVSTQGENFEIVVSGEEEGVDGTSCASPTFASIISLVNDRLIAAGKPPLGFLNPFLYSTGASAFTDITTGDNPGCNTNGFPAKSGWDPVTGLGTPNFSKLLTAVGL

SEQ ID NO: 38 - protein, 559 aa, Trametes versicolor
AVASTLQLHEARKGIPAGFSLHGAASPDTVLNLRMALVQSNFAGLEERLYDVSTPSSANYGKHLSKAEVEQYVAPRQQSITAVKAWLAANGLSGTSISPAGDWIAAKVPVSKANKLLGAQFSVFNNDATGRQIIRTLAYSIPAELKGHLDLVHPTITFADIKPLVPVVSARRESRVLVDSDLVANTIPASCNAAITPACLQDLYGIPSTPATQSSNQLGVSGFIDQFANQADLATFLTEFRPDVSNSTTFTLQTLDGGQNPQDPSDAGVEANLDTQYTVGVATNVPTTFFSVGDDTKDGIFGFLDLISFLLAAAAPPQVLTTSYGADEGGLSANLVRNLCQAYAQLGARGTSILFSSGDGGVSGSQAEGCVDFVPTFPSGCPFLTSVGATQLTTASGLTVETAAGFSSGGFSNYFPTPPYQQAVVDAYIKKTLVNGTVNEGLFNASGRAFPDVSAVGVDYLIVVGGGTDIVSGTSASSPLFASVIALINDRRLAAGKPPLGFLNPFLYSQAGASALNDVTVGSNPGCASPGFPAAQGWDPVTGLGTPNFAKLLAAALAL

SEQ ID NO: 39 - protein, 541 aa, Paecilomyces hepialid
APAPHGPLVKFGEIRKLPSKWVATGAADANAVIKGQIGIKQNNIQGLQAKLADIADPNSPNYGQWLSKEEVDKYSAPAAADVAAVKAWLASSGITDVTMPTNDWIEFSVPVSKMESLLGSKYEWFVHLETGEKVPRTKEFSVPQNLHDLIDVVTPTTVLYHNINPHTHSSPQAAGAAGLTSPASIKSAYNVDYKGTGNTLVGTTGFLGVGASHTDYANFGQQFSPGLKDFQDVSVNGGSNSGDGSALEGNLDTQYCGALAAPNPSEYLAHAPEGSDNNSFNDAMLAFGNYLNSARNPPSAVSTSYGGEEDGVDASYLDRICNEFMKAGSRGVSIFFSSGDNGVGGNGESSCQNGYYPLWPATCPYVTTVGGTEFDNSGREVVANFEQYNKNIKSPGGGYSNHFAAPSYNKAVTTSYANGLAAPQKQRLNPNGRGYPDISLVSVKYQVNVNNQISQVLGTSASSPSIAGLVGLLNDYRKTQGKPNLGFINPLLYSDKVKPALRDVTSGSNKGCDSVGLPAKTGWDAASGLGSFDFGKLRTLV

SEQ ID NO: 40 - protein, 541 aa, Isaria tenuipes
APAPHGPLVKFGELKKLPSQWVATGAANGDAVIKAQIGIKQNNIKGLQDKLAEISDPNSPSYGQWLSKEEVAKYTAPADADVAAVKAWLSSAGITEVTMPTNDWLEFSVPVSKMESLLGSKYEWFVHLETGEKAPRTKEFSVPQNLHGIIDVVTPTTVLYHNINPNSHGNELSASASGLTSPASIKSAYNVDYKGTGNTLVATTGFLGVGASHNDYLAFGHQFSPGLKDFQDVSVNGGSNSGDGSALEGNLDTQYCGALASPNPSQYLANSPEGSDNNSFNDAMTAFGNYLNSASNPPSAVSTSYGGEEDGVDAGYLDRICNEFMKAGSRGISVFFSSGDNGVGGNGEPSCQNGYYPLWPATCPYVTTVGGTEFDDSGREVVANFEQYNKNVKSPGGGYSNHFPAPDYNKNVTTAYANSLSAAQQQRLNPNGRGFPDISLVSVKYQVSLNGQTKQVLGTSASSPSVAGLVGLLNDYRKTQGKSNLGFLNPLLYSGKVNAALRDVTSGSNKGCDSVGLPAKSGWDAASGLGSFDFAKLRSLI

SEQ ID NO: 41 - protein, 578 aa, Aspergillus tamarii
EAFEKLSAVPKGWHYSSTPEGSTSVCLKIALAQKDAAGFEKRVYEMSDPDHPNYGQHFTTHEEMKRMLLPRDDTVDAVRQWLENGGVTDVRQDSDWINFCTTVDTANKLLNAQFKWYVSDVKHIRRLRTLQYDVPGSVASHVNTIQPTTRFGKITPKKAVTHSKPSQLDVTALAAAVVAKNISHCDSIITPTCLKELYNIGDYQADANSGSKIAFASYLEEYARYADLENFENYLAPWAKGQNFSVITYNGGLNDQNSSSDSGEANLDLQYILGVSAPLPVTEFSTGGRGPLVPDLTQPDPNANSNEPYLEFFQNVLKLDQEQLPQVISTSYGENEQEIPEKYARTVCNLIAQLGSRGVSVLFSSGDSGVGEGCMTNDGTNRTHFPPQFPAACPWVTSVGATYKTTPERATYFSSGGFSDYWARPEWQEEAVSSYLETIGDAFKGLYNASGRAFPDVAAQGMNFAVYDKGTLGEFDGTSASAPAFSAIIALLNDARLRAGKPTLGFLNPWLYKTGRQGLQDITLGASTGCTGRARFGGAPDGGPVVPFASWNATQGWDPVTGLGTPDFAELKKLALAN

SEQ ID NO: 42 - protein, 587 aa, Aspergillus brasiliensis
EIFEKLSGVPNGWRYANNPQGNEVIRLQIALQQHDVTGFEQAVMDMSTPGHADYGKHFRTHEEMKRMLLPSDTAVDSVRDWLESAGVHNIQVDADWIKFHTTVTKANALLDADFKWYVSEARHIRRLRTLQYSIPDALVSHINMIQPTTRFGQIQPNRATMRSKPKHADETFLTAATLAQNTSHCDSIITPSCLKQLYNIGDYQADPKSGSKIGFASYLEEYARYADLEKFEQHLAPNAIGQNFTVVQFNGGLNDQLSTKDSGEANLDLQYILGVSAPLPVTEYSTGGRGELVPDLSSPDPNDNSNEPYLDFLQNILKLNNSDLPQVISTSYGEDEQTIPVPYARAVCNLYAQLGSRGVSVIFSSGDSGVGAACLTNDGTNRTHFPPQFPASCPWVTSVGATSKTSPEQAVSFSSGGFSDLWPRPSYQHAAVQTYLTEHLGNKFSGLFNASGRAFPDVSAQGVNYAVYDKGILGQFDGTSCSAPTFSGVIALLNDARLRAGLPVMGFLNPFLYGAGSKLGGLNDIVTGGSVGCDGRNRFGGTPNGSPVVPFASWNATTGWDPVSGLGTPDFAKLKVVALGESEGDEN

SEQ ID NO: 43 - protein, 582 aa, Aspergillus iizukae
EVFDTLAAVPKGWHYSHTPRADQPISLKIALKQHNVEGFEQAVLDMSTPGHEHYGKHFREHDEMKRMLLPSDATVDAVKDWLLAADVTDYEVDADWINLHTTVQQANELLDTEFAWYVSDVRAVRRLRTLRYSVPDAVAPHINMVQPTTRFGQIHPDRATFRAGSTHFGAHILSAMSAVGDVSSANVTCDDVITPLCLKELYKVDGYRAEAEHGSKIAFASYLEEYARYDDMVRFQEKLAPYAKGENFSVILYNGGVDDQQSTSDSGEANLDLQTIMGLSAPLPITEYITGGRGKLIPDLSQPDPNDNSNEPYLEWIQNVLKHSPEELPQVISTSYGEDEQTIPRGYAESVCNLLAQLGSRGVSVIFSSGDSGVGSACQTNDGTNTTHFPPQFPASCPWVTSVGATSKTHPEEAVYFSSGGFSDLWARPAWQDDAVSTYIESIGGKFAGLYNASGRAFPDVSAQGQNYAIFDKGRLGKMDGTSCSAPAFAGIVSLLNDARLRANRPVLGFLNPWLYGTAREGLNDIVHGGSKGCDGRDRFGGKPNGSPVVPYASWNATPGWDPVSGLGTPNFATLVQVALHD

SEQ ID NO: 44 - protein, 456 aa, Penicillium sp.
APASTAKDSVSSVVKNGVKYTVFEHAATGAKMEFVKNSGICETTPGVNQYSGYLSVGSNMNMWFWFFEARNNPQQAPLAAWFNGGPGCSSMIGLFQENGPCHFVNGDSTPSLNEYSWNNYANMLYVDQPIGVGFSYGTDDVTSTVTAAPYVWKLLQAFYAQFPEYESRDFAIFTESYGGHYGPEFASYIQDQNAAIKAGSVSGENINLVALGVNNGWIDSTIQEKAYIDFSYNNSYKQLIDDSQRTSLLSAYNDQCLPAIQKCTSSGSNSDCKNADSVCYNQIEGPISSSGDWDVYDIREPSNDPYPPSTYSTYLSNADVVKAIGAQSSYQECPNGPYNKFTSTGDNPRSFLSTLSSVVKSGINVLVWAGDADWICNWLGNYEVANAVDFSGHTDFSAKDLAPYTVNGTEKGLFKNVDNFSFLRVYGAGHEVPYYQPDTALQVFEQILQKKPIFST

SEQ ID NO: 45 - protein, 456 aa, Aspergillus denticulatus
STASAAKDSVSSIVKNGVKYTVFEHAATGAKMEFVKNSGICETTPGVNQYSGYLSVGDNMNMWFWFFEARNNPQQAPLAAWFNGGPGCSSMIGLFQEHGPCHFVNGEDTPSLNEYSWNNYANMLYVDQPIGVGFSYGTDDVTSTVTAAPYVWKLLQAFYAQFPEYESRDFAVFTESYGGHYGPEFASYIQQQNAAIKAGTVSGENINLIALGVNNGWIDSAIQEKAYIDFSYNNTYKQLISSSDRTRLLSVYNSQCLPAIQKCTSTGTTAACRNADSVCYNNIEGPISSSGDWDVYDIREPANDPYPPATYSTYLADPDVVKAIGAQTSYQECPNGPYNKFASTGDNPRSFLSTLSNVVKSGINVLVWAGDADWICNWLGNYEVANAVDYPGQSEFEAKDLAPYTVNGAEKGMFKNVDNFSFLRVYGAGHEVPYYQPETALQVFQQTLQKKPIFST

SEQ ID NO: 46 - protein, 456 aa, Hamigera sp.
APASTAKDTLSSIVKNGVTYNVFEHADSGAKIEFVKNSGICETTPGVNQYSGYLSVGDNMNMWFWFFEARNNPQKAPLAAWFNGGPGCSSMIGLFQENGPCHFVNGENTPSLNEYSWNNYANMLYVDQPIGVGFSYGTDDVDSTVTAAPYVWKLLQAFYAQFPEYESRDFAIFTESYGGHYGPEFAHYIQQQNAAIKSGSVKGENINLIGLGVNNGWIDSAIQEKAYIDFSYNNSYKQLIDFSQRTSLMRAYKNQCLPAIQKCYQTGTNADCTDASSVCYNNIEGPISSSGDWDVYDIREPSNDPYPPKTYSSYLSDPKVVKAIGARTNYKECPNGPYNKFSTTGDNPRSFLSTLSDVVKSGINVILWAGDADWICNWLGGYGVANAVDYPGHAQFRAKALAPYTVNGTEKGQFKTVDNFQFLKVYGAGHEVPYYQPETALQVFEQILQKKPIHST

SEQ ID NO: 47 - protein, 456 aa, Penicillium janthinellum
APASTAKDTVSSVVKDGVTYTVFEHAATGAKMEFVKNSGICETTPGVNQYSGYLSVGSNMNMWFWFFEARNNPQQAPLAAWFNGGPGCSSMIGLFQENGPCHFVNGESTPSLNENSWNNYANMIYIDQPIGVGFSYGTDRVTSTVTAAPYVWKLLQAFYAQFPEYESRDFAIFTESYGGHYGPEFASYIEQQNAAIKAGSVTGQNVNIVALGVNNGWIDATIQEKAYIDFSYNNSYQQIIDSSTRDSLLDAYNNQCLPALQQCAQSGSNSDCTNADSVCYQNIEGPISSSGDFDVYDIREPSNDPYPPKTYSTYLSDPTVVKAIGARTNYQECPNGPYNKFASTGDNPRSFLSTLSSVVQSGINVLVWAGDADWICNWLGNYAVANAVDFPGNAQFSAMDLAPYTVNGVEKGQFKTVDNFSFLKVYGAGHEVPYYQPDTALQVFKQILQKKPISST

SEQ ID NO: 48 - protein, 456 aa, Penicillium vasconiae
APASTAKDSVSSVVKNGVKYTVFEHAATGAKMEFVKNSGICETTPGVNQYSGYLSVGSNMNMWFWFFEARNNPQQAPLAAWFNGGPGCSSMIGLFQENGPCHFVNGDSTPSLNEYSWNNYANMLYVDQPIGVGFSYGTDDVTSTVTAAPYVWKLLQAFYAQFPEYESRDFAIFTESYGGHYGPEFASYIQEQNAAITAGSVSGQKINLIALGVNNGWIDSTIQEKAYIDFSYNNSYQQLIDDSQRTSLLSAYNKQCLPAIQKCTQTGSNSACQNAANVCYNNIEGPISSSGDWDVYDIREPSNDPYPPSTYSTYLANSDVVKAIGAQSSYQECPNGPYNKFASTGDNPRSFLSTLSSVVKSGINVLVWAGDADWICNWLGNYEVANAVDFSGHAEFSAKDLAPYTVNGAEKGMFKNVDNFSFLKVYGAGHEVPYYQPETALQVFEQILQKKPISST

SEQ ID NO: 49 - protein, 454 aa, Hamigera paravellanea
APSLRDKRSFVERDGVTYTVFEHAATGAKMEFVQNSGICETTPGVNQYSGYLSVGDNMNMWFWFFEARNNPTAAPLAAWFNGGPGCSSMIGLFQENGPCHFVNGESTPSLNEYSFNNYANVLYVDQPIGTGFSYGTDDVTSTVTAAPYVWKLLQAFYAQFPEYESRDFGIFTESYGGHYGPEFASYIQEQNAAIKAGSVSGDNINLVALGINNGWFDAGIQEKAYIDFSYNNSYRQIISSSQRSSYLDAYNHDCLPAIESCASSGTNSACKNAESVCYNGIEGPISSAADFDVYDVRQPSNDPYPPATYSTYLQSASVRKAIGARTKYQECPNGPYNKFETTGDNSRSFLSTLSDVVNTGITVLVWAGDADWICNWVGGHAVADAVTFARQKTFQAKPLEPYTVNGTEKGRFKTVDNFTFLRVYEAGHEVPYYQPETALQVFVQTMQKKAIFST

SEQ ID NO: 50 - protein, 453 aa, Talaromyces variabilis
AAVPQDKRSIVKRDGVTYNVFEHAATGAKMEFVKNSGICETTPGVNQYSGYLSVGDNMNMWFWFFESRNNASGAPLAAWFNGGPGCSSMIGLFQENGPCHFVNGEKKPSLNKYSFNEYANVLYVDQPIGVGFSYGTDDVTSTESAAPYVWKLLQAFYAQFPQYESRDFGIFTESYGGHYGPEFAHYLQQQNEGVKNGSVDGENINLVALGINNGWFDTQLQEGAYIDYAYSNNYKKIIDSSQRSSLEDSLKSDCLPAVKQCLSSGSDSDCENASDTCGQIESSIQQAADFDVYDVREPSNDPYPPSTYSDYLADSSVVKAIGAKSTYKECPNGPYYKFSSTGDNTRSFLSELSSVVQSGIQVLVWAGDADWICNYMGVQRVADAVEFDGSSQFSNATLKPYTVNGTKKGEYKNVDNFSYLRVYGAGHEVPYYQPAVALQVFKQTMQQQAIKST

SEQ ID NO: 51 - protein, 456 aa, Penicillium arenicola
APATHLQDKRSIVERDGVNYTVFEHAATGAKLEFVTNSGICETTSGVNQYSGYLSVGTNMNMWFWFFESRNSPSTAPLAAWFNGGPGCSSMIGLFQENGPCQFYDGASTPSLNPYSFNEYANMIYIDQPIGVGFSYGTDDVTSTVTAAPYVWKLIQAFYASFPAYESREFGLFTESYGGHYGPEFAYYIQQQNAAIASGTVTGDTIDIVALGINNGWIDSALQEKAYIEYSYNNSYKQIITSSQRTSYLSTYTNDCLPAINKCTTGGSNSACSNAADVCYNDIESPIMSDADFDVYDIRQPSNDAYPPETYVTYLQTSSVVKAIGASSTYQECPDAPYNKFATTGDNDRSFLATLSTVVQSGITVLLWAGDADWICNWVGNQYVADAVTWSGQSSFAAQTLTPYTVNGSEVGTFKTLDNLSFLRVYEAGHEVPYYQPATALQAFIQTMQKKALSST

SEQ ID NO: 52 - protein, 354 aa, Nocardiopsis kunsanensis
APAPQNPTEPAEATTMAEALERDLGLNEAEATDLIDAQESALDVDAEATEAAGEHYGGSLFDTETHDLTVLVTDSAAVPGVEAAGAEAAVVEHGVEGLDDLISDLDSAGAQEGVVGWYPEVENDTVVIETLEGADADVDALLSSAGVDPADVRVETTDEAPEVYANIVGGDAYTIGGSSRCSVGFPASDSYGQPGFVTAGHCGTTGSSVSIGNGSGVFSQSVFPGNDAAFVRGTSNFSLTNLVNRYNSGSDVAVSGSTQAPIGSQVCRSGSTTGWHCGTIQARGQTVSYPQGTVRDLTRTSVCAEPGDSGGSFISGSQAQGVTSGGSGNCSWGGTTYYQEVNPMLNSWNLNLST

SEQ ID NO: 53 - protein, 425 aa, Streptomyces parvulus
GTAPSPAAPTAAESLRADAAPPALLRAMERDLGLGREQAERRLGNEAEAGAVAGRLRADLGGDFAGAWVRGAESGTLTVATTDAADVPAIEARGAVAEVVRHSLADLGAAKSRLDRAAAHRDTAEAPVRYVDVRTNTVTVQAVRPSAARALLAAAGVDAGLARVETSAERPRPLYDLRGGEAYYINNSGRCSVGFPVTKGTQQGFATAGHCGRAGASTSGANRVAQGTFQGSVFPGRDMAWVAANSQWTATPYVSGAGGQNVQVAGSTQAPVGASVCRSGSTTGWHCGTIQQHDTSVTYPEGTITGVTRTTVCAEPGDSGGSYISGSQAQGVTSGGSGNCGSGGTTFFQPINPLLQNYGLTLKTTGGGGEDPGEPGEPGGTWAAGTVYRPGDTVTYGGATYRCLQGHQAQRGWEPANVPALWQRV

SEQ ID NO: 54 - protein, 350 aa, Saccharopolyspora endophytica
LTATIADPAGPPVSPELVTAMQRDLGLTADQAVARLGQEAVAARADSALRDALAGSYGGSYFDANLGKLVVGTTDAAKSDEVRAAGAEPRQVDASERQLDGIVEALNGRGAQVPAAVTGWYADVRENAVVVTTQPGTAEQATGFVRDAQVPQESVRVWESPAQPETYADVVGGYAYYTASGARCSMGFAVQGGFVTAGHCGAPGESTTQPTGYFAGSSFPGNDYAFVNTGTDDTGYPLVYNYSSGYVRVSGSAEAPLGSSICRSGSTTGWHCGTVLAKNQSVRYQEGTVSGLTRTNVCAEPGDSGGSFISGNQAQGMTSGGWGDCRTGGETYYQPVREALSAYGLTLLTQ

SEQ ID NO: 55 - protein, 355 aa, Luteus cellwall
ASGPLPQSPSPDSDVATTMAEALERDLNLTSTEAQELLTAQEAAFEADEAAAQAAGDAYGGSVFDTETLDLTVMVTDAAAVQAVEATGAKADVVSYGIDGLDTIIDDLNEADAPEGVVGWYPDIDSDTVVLEVLEGSGADVDALLAEAGVDASAVKVESTTEQPELYADIIGGLAYYMGGRCSVGFAATNASGQPGFVTAGHCGRVGTQVTIGNGRGVFERSVFPGNDAAFVRGTSNFTLTNLVSRYNSGGYATVSGSSVAPIGSSVCRSGSTTGWRCGTIQARGQTVTYPQGTIYNMTRTSACAEPGDSGGSFISGTQAQGVTSGGSGNCSWGGTTFYQEVNPMLNSWNLRLRT

SEQ ID NO: 56 - protein, 406 aa, Saccharothrix australiensis
GPPTTHQEESGLIAAMARDFKITPDQARARLVREAKAATTEQSLKSRLGGHYAGAWLNEGATELVVAVTDAAQAKVVEDAGATPKVVQRSQIQLDELKAKLDANKNAPKDVPAWYVDVKTNSVVVLARNTASAKAFARASGLSEADVRIEQSTEDPRPLIDVIGGNAYYMGSGGRCSVGFSVNGGFVTAGHCGRVGTTTTQPSGTFAGSTFPGRDYAWVRVSSGNTMRGLVNRYPGTVPVKGSNESSVGASVCRSGSTTGWHCGTIQQKNTSVTYPEGTISGVTRTNACAEPGDSGGSWLTGDQAQGVTSGGSGNCSSGGTTYFQPVNPILQAYGLQLVIEGGPTGTTGPTTTSSNPGGTTWQPGVAYTAGTTVTYEGVGYECLQGHTSQIGWEPSAVPALWERVG

SEQ ID NO: 57 - protein, 346 aa, Nocardiopsis baichengensis
DAFPEGTEPLAEAIERDLGVASGQADELLTAEESARSLEKEAEKAAGEAFAGAVFDTETHELTVSVADPSAVEAVEATGAETRVVEASQDELDAAMADLDAASEDGVSEEVTGWHVDLESNTVVVEALEGSEDAAEDLIADAGLDSAPVVVEKADAQPETFGAIVGGDAYYPGNSRCSIGFSVRGGFVTAGHCGSTGTSVSGSAGESGRVAGSVFPGRDMGYVRANSGWTPSPYVNNYRGGRVAVRGSNEASVGASVCRSGSTTGWHCGTIQAKNQTVNYPQGTVRGLTRTTACAEPGDSGGSWLSGNQAQGVTSGGSGNCSWGGTTFFQPVNPILSQWGLSLTTT

SEQ ID NO: 58 - protein, 353 aa, Streptomyces sp.
NDTLTERADAAVAELPAGVLDAMERDLGLSEQEAGLQLVAQYDASLLGETLSADLDAYAGSWLADGTDLVVATTDRAEAAQITEAGAKVEIVDHTLTELESVKAALDEAAESYDTTDAPVWYVDITTNDVVLLTSDTAEAKGFVEAAGVDAGAVSIQTSDEQPQAFYDLVGGDAYYMGGGRCSVGFSVTQGSTPGFATAGHCGTVGTSTTGFNQAAQGTFEESSFPGDDMAWVSVNSNWNTTPTVNDGAVTVSGSTQGAVGASICRSGSTTGWHCGTIEQHNTSVTYPEGTITGVTRTSVCAEPGDSGGSYISGSQAQGVTSGGSGNCTSGGTTYHQPINPLLSAYGLDLVTG

SEQ ID NO: 59 - protein, 353 aa, Actinoalloteichus spitiensis
DTPSPDGADATVASPEMLSAMQRDLGLTEQEALTRVAVEATAVETEDELRASLGPAFGGAHFDGDTNTLVVGVTSAAKADEVRAAGATPEVVAFSADTLDGVVSTLNETSEVPDGVTGWYVDTADNTVVVTTALGSGEAAADFVAESGVNADAVTVVESTEQPRTLYDIIGGDAYYFGGSRCSVGFSVSVGYVTAGHCGGVGTATQGYNRVSSGQVAGSVFPGSDMGYVRTNANWTPRPLVNRYSGGATVTVSGSNEAAVGASICRSGSTTGWRCGTVQAKNQTVFYAQGAVSGLTRTNACAEGGDSGGSWLSGSQAQGVTSGGSGNCTWGGTTYFQPLNPILSRWGLSLTRG

SEQ ID NO: 60 - protein, 338 aa, Byssochlamys verrucosa
FPAAVDVKRAPSSLGITLSQVSNTLIKAVVQNTGRGEVSFIHLNFFKDDAPVKKVAVYRNGSEVQFEGIQRRYKSTGLTRDAFTTLAPGKTAEDVFDIASTCDLISGGPVTIRSEGVVPYATANGIDIAGYIPYSSNELTIDVDGAIASTVSKAIAPLNRRTNISSCSGSEQSTLTMALKNAASLAHAAADAAESGSASKFSEYFKTTASSTRKTVAARLRAVAQEASSSSSGSTTYYCNDAYGYCTTNVLAYTLPSHNTIATCDLYYTNLSALTRTCHAQDQATTSLHEFTHAPGVYSPGTDDLAYGYASSTSLSSSQAVMNADSYALYANAIYVGC

SEQ ID NO: 61 - protein, 339 aa, Hamigera terricola
SPVNVNVGREELPALDVTLSQIGNTQIKAVVKNTGSEDVTFMHLNFFTDSAPVKKVSVFQNNTEVEFQGILRRVKYTDVSTDSVTTLAPGASIEDVFDIATTTDLASGGAVTVKTDGFVPILASAENKVTGYARYTSNELHLDVDGPSAATVSKAIAPLDRRTRLSSCSGSRSSALQTALRNTVSLANAAANAARSGSASKFSEYFKTTSSSVRSTVAARLSAVASEASSTSSGSTTYYCNDPYGYCSTDVLAYTLPSYNIIANCDIYYSYLPALTGSCHAQDQATTTLHEFTHAPGVYSPGTEDYGYGYNAATSLSSSQAVLNADSYALYANAIYLGC

SEQ ID NO: 62 - protein, 334 aa, Aspergillus tamarii
IPVEVPASAPGLDVTLSQVGNTRIKAVVKNTGSEEVTFVHLNFFKDAAPVQKVSLFRNATEVQFQGIKQRLITEGLSDEALTTLAPGATIEDEFDIASTSDLSEGGTITINSNGLVPITTENKVTGYIPFASNELSIDVDAAEAATVSQAVKILDRRTKVTSCSGSRSSALQTALRNTVSLARAAASAAQSGSSSRFQEYFKTTSSSTRSTVAARLNAVANEAASTASGSTTYYCSDVYGYCSSNVLAYTLPAYNIIANCDLYYSYLPALTSTCHAQDQATTTLHEFTHAPGVYSPGTDDLGYGYSAATALSASQALLNADTYALFANAVNLNC

SEQ ID NO: 63 - protein, 334 aa, Aspergillus niveus
LPAKTGEQLQKLDVALSQVDNTLIKAVVKNTGSEDITFVHLNFFRDTAPVKKVSLFRNTTEVPFHGIKQRLRSDGLSADALTVLAPGESIEDEFDIAATSDLSEGGSITISADGFVPIASGNKITGYVPFSSNELSVEVDAAQAASVASAVKPLDRRTKVASCSGSRSSALTQALRNTVSLANAAASAAQSGSSTRFQEYFKTTSSSVRSSVAARFRAVASEASSTSAGSTTYYCTDVYGYCSSNVLAYTLPAYNIIANCDIYYTYLPALTSTCHAQDQATTTLHEFTHAPGVYSPGTDDLGYGYDAATALSSSQALNNADSYALFANAVNLNC

SEQ ID NO: 64 - protein, 372 aa, Penicillium sclerotiorum
IPTGGKKSSFSVDQVAIPATKTKNFADTYARAISKFGGNVPSHVRAAAQQSGAATTTPEANDEEYLTPVNVGGTTLNLDFDTGSADLWVFSEQLPSSEQSGHSVYKPNNGTKLSGATWSISYGDGSSASGDVYKDTVSVGPVKATGQAVEAASKISAQFTRDSNNDGLLGLAFSSINTVKPKAQTTFFDTVKSSLASPLFAVTLKHNAPGTYDFGFVDSSKYTGSLAYTDVDNSQGFWEFTADSYKVGSQSGSSIKGIADTGTTLLLLDDEVVSAYYKQVSGASDSQSAGGYTFDCSADLPDFTVTISGYDAVVPGSLINYAPVSDGSSTCLGGIQSNSGIGFSIFGDIFLKSQYVVFDSNGPRLGFAAQSS

SEQ ID NO: 65 - protein, 371 aa, Penicillium bilaiae
VPTGGKKSFSINQVAIPATKTKNFAGNYAHAIAKYGGNVPSHVEAAAQQSGAATTTPESNDEEYLTPVNVGGTTLNLDFDTGSADLWVFSAELPSAEQSGHALYKPSNGTKLSGASWSISYGDGSSASGDVYKDTVSVGSVKATGQAVEAASKISAQFTKDKNNDGLLGLAFSSINTVKPKAQTTFFDTVKSSLASPLFAVTLKHNAPGTYDFGFIDKSKYTGSLAYADVDNSQGFWEFTADSYSVGSSKGSSIKGIADTGTTLLLLDDEVVSAYYKQVQGAQQDSSAGGYTFDCSSKLPDFTVTISGYDAVVPGDLINFAPASEGSSTCLGGIQSNSGIGFSIFGDIFLKSQYVVFDSNGPRLGFAAQSS

SEQ ID NO: 66 - protein, 373 aa, Penicillium antarticum
SPLVTPRKGFTINQETRAVTKSKTVNLPGVYAQALSKYGATVPQHVHAAAVSGSAVTTPEESDVEYLTPVNVGGTTLNLDFDTGSADLWVFSSELTSSQQSGHSIYKPSSSATKLSGSSWSISYGDGSSASGDVYKDTVTVGGVKATGQAVEAASKISSAFLQDVNNDGLLGLAFSSINTVSPRAQTTFFDTVKSQLDSPLFAVTLKHNAPGSYDFGYIDKSKYTGSLTYANVDDSQGFWSFTASSYKIGTTTGGSITGIADTGTTLLLLPDSVVSAYYKKVSGSQNSNYYGGYVFPCSATLPDFTVTINGYNAVVPGNLINFAQATTGSSTCYGGIQSNSGIGFSIFGDIFLKSQYVVFDSEGPRLGFAAQA

SEQ ID NO: 67 - protein, 370 aa, Penicillium sumatrense
VPTNNVASKFSVNQVSRPATKTTNFAANYGRALSKYGAGVPSHVEAAAAASGSAVTTPESNDVEYLTPVSIGGTTLNLDFDTGSADLWVFSTELSSSEQSGHSVYNPSKSGKKISGASWDISYGDGSGASGDVYTDTVTVGGVTASKQAVEAAKQISSQFQQDTDNDGLLGLAFSSINTVSPTPQKTFFDNVKSSLSQPLFAVALKHNAPGVYDFGFIDSSKHTGSIAYTSVDSSQGFWSFTVDGYKVGSKSGAGFDGIADTGTTLLLLDDSVVSAYYSQVSGAKNDNNAGGYVFDCSADLPDFSVTIGSYTATVPGSLINYGDSGDNSCIGGIQSNSGIGFSIFGDIFLKSQYVVFNANGPKLGFAPQA

SEQ ID NO: 68 - protein, 384 aa, Trichoderma lixii
LPTEGQKTASIEVTYNKNYVAHGPTALFKAKRKYGAPISDNLRAAVAAKHSLTKRQTGSANTNPSDSADDEYITSVSIGTPAQVLPLDFDTGSSDLWVFSSETPKSSASGHVTYSPSKSSTAKKLSGSTWSITYGDHSSSSGDVYTDVVSIGGFSVKTQAIESATKVSTQFVQDTVISGLVGLGFDVGNTVKPRAQKTWFSNAASSLAEPLFTADLRHQETGSYNFGFIDNSLAKGTIGYTPADGSEGYWGFTATGYSVGGAKLGRSSITGIADTGTTLLLLPDNVVDAYYNNVESAQYDDSQEGVVFDCSEDLPSFSFGVGGQTITISGDLLNLTPIEEGSSTCFGGLQSSADIGINIFGDVALKAALVVFDLGNERLGFAQK

SEQ ID NO: 69 - protein, 384 aa, Trichoderma brevicompactum
LPTEGQKTASVEVTYNQNYAAHGPTQLYKAKRKYGAPISDNLKAIVANRKALIKRQTGSAPNHPSDSADDEYITNVSIGTPAQVLPLDFDTGSSDLWVFSSETPKSSASGHTIYTPSKSSTSKKLSGATWSIEYGDKSTSSGDVYTDKVTVGGFSVSTQAVESATKVSAQFVQDTANSGLLGLAFDSINTVSPRQQKTWFSNAANSLAQPLFTANLNHQATGSYNFGFIDTSLASGPINYVPVDNSQGFWGFTASGYSVGGGKLNRSSLSGIADTGTTLLLLPDAVVNAYYANVESAEYDDEQEGVVFDCSEDLPTFSFGVGSGTITIPGDLLNLTPIDSSGQTCYGGLQSSSDIGINIFGDVALKAALVVFDLGNERLGWAQK

SEQ ID NO: 70 - protein, 379 aa, Penicillium cinnamopurpureum
IPTGVPNRKGFTVNQQVRPVTNGTKSKTLNLPAIYANALSKYGVAVPANIKAAAESGTATTTPEDNDIEYLTPVDVGGTTLNLDFDTGSADLWVFSSELPSSESSGHSIYKPSQSGKKLDGYSWKISYGDSSSASGDVYTDTVTVGGVTADGQAVEAAKKISQQFVQDKNNDGLLGLAFSSINTVQPKAQTTFFDTVKDQLDSPLFAVTLKHNAPGSYDFGFIDKSKYTGSLTYADVDKSDGFWAFTADGYSVGSGSSSSSRIKGIADTGTTLLLIDDEIVSAYYKQVDGAQESYSVGGYTFDCSTKLPDFNIKIGDYTAVIPGDVINYAPVQQGSSTCFGGIQSNSGLPFSIFGDIFLKSQYVVFDANGPRLGFAAQA

SEQ ID NO: 71 - protein, 350 aa, Bacillus lichenformis
AQPAKNVEKDYIVGFKSGVKTASVKKDIIKESGGKVDKQFRIINAAKAKLDKEALKEVKNDPDVAYVEEDHVAHALAQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 72 - protein, 360 aa, Bacillus subtilis
FSNMSAQAAGKSSTEKKYIVGFKQTMSAMSSAKKKDVISEKGGKVQKQFKYVNAAAATLDEKAVKELKKDPSVAYVEEDHIAHEYAQSVPYGISQIKAPALHSQGYTGSNVKVAVIDSGIDSSHPDLNVRGGASFVPSETNPYQDGSSHGTHVAGTIAALNNSIGVLGVAPSASLYAVKVLDSTGSGQYSWIINGIEWAISNNMDVINMSLGGPTGSTALKTVVDKAVSSGIVVAAAAGNEGSSGSTSTVGYPAKYPSTIAVGAVNSSNQRASFSSAGSELDVMAPGVSIQSTLPGGTYGAYNGTSMATPHVAGAAALILSKHPTWTNAQVRDRLESTATYLGSSFYYGKGLINVQAAAQ

SEQ ID NO: 73 - protein, 548 aa, Trametes cf versicol
TPTARNLKLHESREEIPAGFSLSGAASPDTTLKLRLALVQSNFAELEDKLYDVSTPSSANYGQHLSKEEVEQLVAPSAESVNAVNAWLTENGLTAQTISPAGDWLAFEVPVSKANELFDADFSVFTHDESGLKAVRTLAYSIPAELQGHLDLVHPTITFPNPNSHLPVVRSPVKPVQNLTSRAVPASCASTITPACLQALYGIPTTKATQSSNKLAVSGFIDQFANSADLKTFLGKFRTDISSSTTFTLQTLDGGSNSQSSSQAGVEANLDIQYTVGLASAVPTIFISVGDDFQDGDLEGFLDIINFLLNESAPPQVLTTSYGQNENTISAKLANQLCNAYAQLGARGTSILFASGDGGVSGSQSSSCSKFVPTFPSGCPFMTSVGATQGINPETAADFSSGGFSNVFARPSYQSTAVSSYLTALGSTNSGKFNTSGRAFPDIATQGVDFEIVVSGRTEGVDGTSCASPTLAAIISLLNDRLIAAGKSPLGFLNPFLYSAAGTAALTDITSGSNPGCNTNGFPAKAGWDPVTGLGTPNFAKLLTAVGL

SEQ ID NO: 74 - protein, 439 aa, Bos taurus
MAKEYFPFTGKIPFEGKDSKNVMAFHYYEPEKVVMGKKMKDWLKFAMAWWHTLGGASADQFGGQTRSYEWDKAECPVQRAKDKMDAGFEIMDKLGIEYFCFHDVDLVEEAPTIAEYEERMKAITDYAQEKMKQFPNIKLLWGTANVFGNKRYANGASTNPDFDVVARAIVQIKNSIDATIKLGGTNYVFWGGREGYMSLLNTDQKREKEHMATMLGMARDYARAKGFKGTFLIEPKPMEPSKHQYDVDTETVIGFLKAHGLDKDFKVNIEVNHATLAGHTFEHELACAVDAGMLGSIDANRGDAQNGWDTDQFPIDNFELTQAMLEIIRNGGLGNGGTNFDAKIRRNSTDLEDLFIAHISGMDAMARALMNAADILENSELPAMKKARYASFDSGIGKDFEDGKLTFEQVYEYGKKVEEPKQTSGKQEKYETIVALHCK

SEQ ID NO: 75 - protein, 591 aa, Saccharomyces cerevisiae
MLCSVIQRQTREVSNTMSLDSYYLGFDLSTQQLKCLAINQDLKIVHSETVEFEKDLPHYHTKKGVYIHGDTIECPVAMWLGALDLVLSKYREAKFPLNKVMAVSGSCQQHGSVYWSSQAESLLEQLNKKPEKDLLHYVSSVAFARQTAPNWQDHSTAKQCQEFEECIGGPEKMAQLTGSRAHFRFTGPQILKIAQLEPEAYEKTKTISLVSNFLTSILVGHLVELEEADACGMNLYDIRERKFMYELLHLIDSSSKDKTIRQKLMRAPMKNLIAGTICKYFIEKYGFNTNCKVSPMTGDNLATICSLPLRKNDVLVSLGTSTTVLLVTDKYHPSPNYHLFIHPTLPNHYMGMICYCNGSLARERIRDELNKERENNYEKTNDWTLFNQAVLDDSESSENELGVYFPLGEIVPSVKAINKRVIFNPKTGMIEREVAKFKDKRHDAKNIVESQALSCRVRISPLLSDSNASSQQRLNEDTIVKFDYDESPLRDYLNKRPERTFFVGGASKNDAIVKKFAQVIGATKGNFRLETPNSCALGGCYKAMWSLLYDSNKIAVPFDKFLNDNFPWHVMESISDVDNENWIAIIPRLSP

SEQ ID NO: 76 - protein, 444 aa, Bacillus subtilis
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTFDYAAISNEVKSIPNWTHGNTQIKNWSDRWDVTQNSLLGLYDWNTQNTQVQSYLKRFLERALNDGADGFRFDAAKHIELPDDGSYGSQFWPNITNTSAEFQYGEILQDSASRDAAYANYMDVTASNYGHSIRSALKNRNLGVSNISHYAYDVSADKLVTWVESHDTYANDDEESTWMSDDDIRLGWAVIASRSGSTPLFFSRPEGGGNGVRFPGKSQIGDRGSALFEDQSITAVNRFHNVMAGQPEELSNPNGNNQIFMNQRGSHGVVLANAGSSSVSINTPTKLPDGRYDNKAGAGSFQVNDGKLTGTINARSVAVLYPDDIEIRCNTFFQ

SEQ ID NO: 77 - protein, 476 aa, Saccharomycopsis fibuligera
QPVTLFKRETNADKWRSQSIYQIVTDRFARTDGDTSASCNTEDRLYCGGSFQGIIKKLDYIKDMGFTAIWISPVVENIPDNTAYGYAYHGYWMKNIYKINENFGTADDLKSLAQELHDRDMLLMVDIVTNHYGSDGSGDSIDYSEYTPFNDQKYFHNYCLISNYDDQAQVQSCWEGDSSVALPDLRTEDSDVASVFNSWVKDFVGNYSIDGLRIDSAKHVDQGFFPDFVSASGVYSVGEVFQGDPAYTCPYQNYIPGVSNYPLYYPTTRFFKTTDSSSSELTQMISSVASSCSDPTLLTNFVENHDNERFASMTSDQSLISNAIAFVLLGDGIPVIYYGQEQGLSGKSDPNNREALWLSGYNKESDYYKLIAKANAARNAAVYQDSSYATSQLSVIFSNDHVIATKRGSVVSVFNNLGSSGSSDVTISNTGYSSGEDLVEVLTCSTVSGSSDLQVSIQGGQPQIFVPAKYASDICS

SEQ ID NO: 78 - protein, 487 aa, Debaryomyces occidentalis
QPIIFDKRDVGSSADKWKDQSIYQIVTDRFARSDGSTTADCLVSDRKYCGGSYKGIIDKLDYIQGMGFTAIWISPVVEQIPDNTAYGYAYHGYWMKNIDELNTNFGTADELKQLASELHSRSMLLMVDVVYNHYAWNGDGSSVDYSSFTPFNQQSYFHDYCLITNYNDQTNVEDCWEGDTEVSLPDLSTEDNEVIGVFQTWVSDFVQNYSIDGLRIDSAKHVDTASLTKFEDASGVYNLGEVYQGDPTYTCPYQSYMKGVTNYPLYYPVYRFFSDTSATSSELTSMISTLQSSCSDVSLLGNFIENHDQVRFPSVTSDTSLIKNAMAFIILGDGIPIIYYGQEQGLNGGSDPANREALWLSGYNTDSEYYELISKLNQIRNQAIKKDSAYSTYKSSVVSSSDHYIATRKGSDANQLISIFNNLGSNGSQDITVSNTGYSSGDKVIDIISCNSVSAGDFGSLSVSISGGMPQVYAPSSVLSGSGICNQ

SEQ ID NO: 79 - protein, 487 aa, Debaryomyces occidentalis
KPIFLSKRDAGSSAAAAWRSESIYQLVTDRFARTDGSTSATCNTGDRVYCGGTFQGIIDKLDYIQGMGFTAIWISPVVEQIPDDTGYGYAYHGYWMKDIYAINSNFGTADDLKNLSNELHKRNMKLMVDIVTNHYAWNGAGSSVAYSNYNPFNQQSYFHDYCLITNYDDQTNVEDCWEGDNTVSLPDLRTEDSDVSSIFNLWVAELVSNYSIDGLRIDSAKHVDESFYPSFQSAAGVYLLGEVYDGDPAYTCPYQNYMSGVTNYPLYYPMLRFFQGTSNSVDELNAMISSLESDCKDITLLGNFIENHDQPRLPSYTSDSALIKNAIAFNLMSDGIPIIYYGQEQGYSGSSDPNNREALWLSGYSTSNGYYKLISSVNQIRNQAIYKDSKYTTYWSDVLYASGHVIALQRGADDQRIVSVFNNLGSSGSQTVTFSTKYSGGEKVVDVLTCQTSYANSDSTLTVSISGGAPRIYAPASLIANSGICNF

SEQ ID NO: 80 - protein, 570 aa, Lipomyces kononenkoae
MCGSTLSASLYVYNDDYDKIVTLYYLTSSGTTGSTLALILPVWSNNWELWTLSAIAAGAVEITGASYVDSDTSVTYTTSLDLPLTTTSASVPTGTAANWRGRSIYQVVTDRFARTDGSITYSCDVTDRVYCGGSYRGIINMLDYIQGMGFTAIWISPIVENIPDDTGYGYAYHGYWMKDIFALNTNFGGADDLIALATELHNRGMYLMVDIVVNHFAFSGNHADVDYSEYFPYSSQDYFHSFCWITDYSNQTNVEECWLGDDSVPLVDVNTQLDTVKSEYQSWVKQLIANYSIDGLRIDTVKHVQMDFWAPFQEAAGIYTVGEVFDGDPSYTCPYQENLDGVLNYPVYYPVVSAFQRVGGSISSLVDMIDTLKSECIDTTLLGSFLENQDNPRFPSYTSDESLIKNAIAFTILSDGIPIIYYGQEQGLNGGNDPYNREALWPTGYSTTSTFYEYIASLNQIRNHAIYIDDTYLTYQNWVIYSDSTTIAMRKGFTGNQIITVLSNLGSSGSSYTLTLSNTGYTASSVVYEILTCTAVTVDLSGNLAVPMSGGLPRVFYPESQLVGSGICSM

SEQ ID NO: 81 - protein, 476 aa, Lipomyces kononenkoae
KTAAEWKELSIYQVITDRFATTNLTAPDCWIRAYCGGTWKGLERKLDYIQNMGFDAVWISPVIHNIEVNTTWGFAFHGYWGDDPYRLNEHFGTAADLKSLSDSLHARGMSLMVDVVINHLASYTLPQDVDYSLYPAPFNTSSAFHQPCPIDFSNQSSIEDCWLVTEPAPALVDLKNEDQVILDALINSVVDLVETYDIDGIRLDTARHVPKPSLAKFQEKVGVFVTGEALNQSVPYVAQYQGPLNSAINYPLWYALVDSFMGRTTFDYLESVVKSEQATFSDAHALTNFLDNQDQPRFASYLGDGNGDDVLRDENAATFLFFVSGIPVIYYGFEQRFDGGFDPVNREPMWTSGYNTSTPLYNYLARLNAIRKYAASITGTQVFYSDDTVFLGSGVSHMAMQRGPLVIVLTNVGQHIIDNTGYTVTGSQFSAGDSLTDLVSCTKVKVVGANGTFTSPSNGGKARIWIKSKYAGKFCS

SEQ ID NO: 82 - protein, 626 aa, Bacillus subtilis
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITLRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 83 - protein, 483 aa, Bacillus subtilis
VNGTLMQYFEWYTPNDGQHWKRLQNDAEHLSDIGITAVWIPPAYKGLSQSDNGYGPYDLYDLGEFQQKGTVRTKYGTKSELQDAIGSLHSRNVQVYGDVVLNHKAGADATEDVTAVEVNPANRNQETSEEYQIKAWTDFRFPGRGNTYSDFKWHWYHFDGADWDESRKISRIFKFRGEGKAWDWEVSSENGNYDYLMYADVDYDNPDVVAETKKWGNWYANELSLDGFRIDAAKHIKFSFLRDWVQAVRQATGKEMFTVAEYWQNNAGKLENYLNKTSFNQSVFDVPLHFNLQAASSQGGGYDMRRLLDGTVVSRHPEKAVTFVENHDTQPGQSLESTVQTWFKPLAYAFILTRESGYPQVFYGDMYGTKGTSPKEIPSLKDNIEPILKARKEYAYGPQHDYIDHPDVIGWTREGDSSAAKSGLAALITDGPGGSKRMYAGLKNAGETWYDITGNRSDTVKIGSDGWGEFHVNDGSVSIYVQK

SEQ ID NO: 84 - protein, 589 aa, Bacillus subtilis
MMEYAAIHHQPFSTDAYSYDGRTVHIKIRTKKGDADHIRFIWGDPYEYNDGKWSANEQPMRKIAATEMHDYWFAEVVPPFRRLQYAFVVTDDHEDIFFGSSGVCPYNEKTLETIHYYFKFPFVHEADTFQAPEWVKSTVWYQIFPERFANGREDLSPKNALPWGSKDPGVNDFFGGDLQGIVDKLDYLEDLGVNGIYLTPIFSAPSNHKYDTLDYFSIDPHFGDPEIFRTLVSQLHQRGMRIMLDAVFNHIGSASPQWQDVVKNGDQSRYKDWFHIHSFPVTDDNYDRFAFTADMPKLNTANPEVQKYLLDIALYWIREFDIDGWRLDVANEVDHVFWKTFRQAVSTEKPDVYILGEIWHSAEPWLRGDEFHAAMNYPFTEPMIEYFADQTISASRMAHRVNAHLMNGMKQANEVMFNLLDSHDTKRLLTRCRNDEKKARALLAFMFAQTGSPCIYYGTEIGLDGENDPLCRKCMVWEKEKQNQDMLQFMKRLIALRKQENTLLTEGHLEWNLLDDKNDFISFSRTLDEKILIYFFNQGNVVQHISLRELNIDRNNKICDAWTEQPLHYHDVIAVQPGEFLILSAAAPV

SEQ ID NO: 85 - protein, 483 aa, Bacillus lichenformis
ANLNGTLMQYFEWYMPNDGQHWKRLQNDSAYLAEHGITAVWIPPAYKGTSQADVGYGAYDLYDLGEFHQKGTVRTKYGTKGELQSAIKSLHSRDINVYGDVVINHKGGADATEDVTAVEVDPADRNRVISGEHLIKAWTHFHFPGRGSTYSDFKWHWYHFDGTDWDESRKLNRIYKFQGKAWDWEVSNENGNYDYLMYADIDYDHPDVAAEIKRWGTWYANELQLDGFRLDAVKHIKFSFLRDWVNHVREKTGKEMFTVAEYWQNDLGALENYLNKTNFNHSVFDVPLHYQFHAASTQGGGYDMRKLLNGTVVSKHPLKSVTFVDNHDTQPGQSLESTVQTWFKPLAYAFILTRESGYPQVFYGDMYGTKGDSQREIPALKHKIEPILKARKQYAYGAQHDYFDHHDIVGWTREGDSSVANSGLAALITDGPGGAKRMYVGRQNAGETWHDITGNRSEPVVINSEGWGEFHVNGGSVSIYVQR

SEQ ID NO: 86 - protein, 478 aa, Aspergillus niger
ATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASRNAIRNYAISKDTGFVTYKNWPIYKDDTTIPMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 87 - protein, 477 aa, Aspergillus niger
ATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASRNAIRNYAISKDTGFVTYKNWPIYKDDTTIPMRKGTDGSQIVTILSNKGASGDSYTLSLSGAGYTAGQQLTEVIGCTTVTVGSDGNVPVPMAGGLPRVLYPTEKLAGSKICYG

SEQ ID NO: 88 - protein, 431 aa, Streptomyces avermitilis
SPPGTKDVTAVLFEWKFDSVARECTNTLGPAGYGYVQVSPPAEHIQGSQWWTSYQPVSYKIAGRLGDATAFQNMINTCHTAGVKVVVDTVVNHMSAGSGTGTGGSAYTKYNYPGLYSSYDMDDCTATITDYTNRANVQNCELVGLADLDTGEEYVRKTIAGYMNTLLGYGADGFRVDAVKHIPAADLANIKSRLTNPSVYWKQEVIYASGEAVQPTEYTGNGDVQEFRYAYDLKRVFNNENLAYLKNYGEGWGYLNSSVAGVFVDNHDTERNGSTLNYKDGANYTLANVFMLAYPYGAPDINSGYEWSDADAGPPGGGTVNACWQDGWKCQHAWPEIKAMVAFRNATRGESVTNWWDNGGDAIAFGRGAKGYVAINHESGSLTRTYQTSLTAGTYCNVQNNTGVTVDSSGRFTATLGANTALALYSGKSTC

SEQ ID NO: 89 - protein, 643 aa, Clostridium phytofermentans
MYTLKSKLRDLYRHPVGYDVINKILLQAGLSKGLIENPVIGALPLSFLNRIAGKKLGNGFFDALLALLNQSNDRLDPYSSKDKKITPTWWKEAVFYQIYPRSFMDGNGDGVGDLPGIISKLDYLKELGVDALWLSPIYDSPGDDNGYDIRDYQKIDSQFGTMEDFDLLLTELHARNMRLVMDLVVNHTSDEHHWFKEALKSSESTYRDYYFLRKEPNNWTSFFSGSAWNHYPEEDLWGLHLFSKKQMDLNWENPKLRQDIYQMIRWWLEKGVDGFRLDVINYISKETGLPDGDSFIGNLMGFTGIEHYFYGPKLHNHLQEIQKEAFTPYQAFSVGETPGIGMKMGKLLTDDSRGELNMMFSFDHLETSGHARFDQYEYDLNYYKSYIMDWMENFADTSWMSLFYDNHDNPRMLSKVDHTHTHRQELAKMLAMIQMTLKGTPFLYQGQELGMINKDFHEISNFRDVESINKYKELCEKMPKEEAFLQILAGSRDHARTPMQWSAKPGCGFSNAVPWIDSDGDELVCNAEIQMQDSESVLSFYRDLIALRRKTPALIYGDIEFTHKKRKDILIYTRYLEGETYLIICNLSNDEQKLPGNVPVSESLEGLESLSASADERKGLVLCNYPAKVMKSLRAYEGRVYRI

SEQ ID NO: 90 - protein, 1016 aa, Clostridium phytofermentans
ATDTITIHYHRDDGDYEKWNLWLWAEGKDGAAYYFDGEDAFGPYVSVSLDKSADRIGFIVRTDSWEKDVSEDRFIDTSLGDEIWISSGESTFSYEAPEGYEKEVSIESFQLKLNYLRYDEEYTDISFRLTFEDGTTDFLTKEHMRIENGILKAEKEVKYGKKITLDVLKNGLEEDYQGVSFSTAKIDEESKLEMYWMQGTGTISPKADFIKRSKEIESALITSMKEITVKLSVPCRVDDIKQDGFKLSPKLAVSKVEATSTRDSEYKTIKEGYADTFIITMEEPLDMSKKYALSKTDYGSRNLTLDSGLYTSEEFEAAYTYEGNDLGATYSKEKTVFKVWSPSAESISVLFYPHGEAKDGEKPEITYPMKQTGAGVWQAEIEGDLKNKYYVYQVTVDGKTKLVVDPYAKAAGVNGERGMVIDLSETDPDGFREHSSPEFKNPVDAVIYEIHVRDLSMNENSGIENKGKFLGFTETGTTNSAGLSTGLDHMKELGVTHVHLLPSFDYKTIDESKLGENKFNWGYDPQNYNLPEGSYTTDPYQGEVRVREYKEMVQALHENGLHVVMDVVYNHTYTAGDSNFTSLVPGYYYRTDINGNFTNGSGCGNETASERAMVRKFIVDSVVYWATEYKVDGFRFDLMGLHDIETMNMVREALDKIDPSILLYGEGWTGGSTPLPDSKQAIKNNAVELNERIACFSDDIRDAIKGSVFDASDTGFINSGKRNVSNRDESIKFGIVASVSHPQVNLSGVPYSSRFWANEPSQTINYASAHDNLTLWDKLLETNKMASKEELVQMNKLSAAIVLTSQGIPFFQAGEEMARTKKGNDNSYQSPDSINMLNWDNKTEYKDLFEYYKGLIALRKTYDAFRMQTAEEIQQKLEFVDSDSSVIAYRIHDAVKDGREIALIFNGTLEEKEVVLSANAWDVLVNQDTAGTDVIETITGGTIKVPAKSTLVLLENKDAVIKGDKDAVKGDEIQELPTNMQEVAEKESGNAWLWVGIATVCVLAGGVLFWILKRKR

SEQ ID NO: 91 - protein, 554 aa, Clostridium phytofermentans
MKNTNTLHPWWESAAAYQIYPRSFMDSNGDGVGDLQGIISRLPYLSELGFDLIWICPIYPSPNDDNGYDISDYQNIQKEYGTMEDFEELLHKAHERGIRVIMDLVVNHTSSSHPWFIESRSSKDNPKRDWYIWKDGKDNVEPNNWESIFGGSTWEYDEKSGQYFLHVFGKTMPDINWENTQVKKAIFDMICWWLDKGIDGFRVDAISHIKKPDFNDMPNPKNERYVSSFDKHMNQSGILDLLNELKENAFSKYDIFTVAEANGVRIEEIEEWVSSEKGIFNSLFQFDHLNLWNVGSEEGKISIKKLKNALTKWQKAAPMDGNVALVMENHDLVRSISRFGSEDKYWKESAKCLALMYYMQKGVPFIYQGQEIGMLNADYESHLDFRDDPTLFAYQDRINNGMSPAESLQVLKKSSRDNSRTPMQWDASPHAGFTTGTPWMKVNQNYHWLNAEVQKEDEDSILNFYKKLIKIKKETTGLIYGDYKLLMEESESIYAYTREYEEKNYLVVCNLSEELSELQIDLDITKGEILISNYEDRNSKEMLLKPYECRLYSL

SEQ ID NO: 92 - protein, 538 aa, Clostridium phytofermentans
MVKKWWHSSVVYQIYPRSFNDSNGDGIGDLKGIIEKLDYLKNLGIDVIWLSPVFKSPNDDNGYDISDYEDIMDEFGTLEDMELLLKEANNRGIKILMDLVANHTSDEHKWFIESRKSKDNAYRDYYIWRDPVDGHEPNDLGSTFSGSAWEWDEATGQYYLHLFSKKQPDLNWENPIVREEVWKSMNFWIDKGIGGFRMDVIELLGKIPDEKIISNGPMLHEYIREMNRNSFGDKDLLTVGECWGATPEIAKMYSNPDGSELSMVFQFEHIGLDQIPGKDKWDLQPLNLIDLKNVFHKWQTCFHDDGWNSLFWNNHDTPRIVSRWGNDKVYKIESAKMLATLLHGLKGTPYIYQGEELGMANIKFKDINQYKDIETLNMYKDRLNKGYKHEDIMESIYAKGRDNARTPMQWSDEIDGGFTTGTPWIEVNPNFTEINAKEQVSNPNSIYNYYKKLIEIRKNNEVIVYGDFEMLLPEDKNIFAYVRTLKDSKIVVVCNFYENEVEYNIPKEYEEKKEVLISNYGLSLTGRLRPFEAIMYRV

SEQ ID NO: 93 - protein, 555 aa, Clostridium phytofermentans
CKKADVNQNPSELNQDESQKEKEENDDEGTPEVSQDETKAVIPYDYVQNLNIIDDNYRNFYEIFVYSFYDSNGDGIGDINGVISKLDYINDGNDATDSDLGFNGIWLMPIMPSTTYHKYDVTDYYNIDPQYGTLEDFKNLVSECHKRGIHLIIDFVFNHTSAKHPWFLEAVSYLESLKEGEEPDLEKCPYVGYYHFTKDYNGSKTYYKAGTSNWYYEGVFWDQMPDLALENENVRKEIEDIAKYWLDLGVDGFRLDAAKEYFSGEKERNIEVLKWFSDYVKSVKEDADIVAEVWDEEGTIAAYYESGIPSLFNFPLSQHNGLITNTARKLGTSSGKNFAKTLLRLDEKYKEGNPKYIDAPFISNHDTTRISAQCVNDEDQMKMSAGMLLTMNGSPYVYYGEEIGMNSKGTKDENKRLPMQWSATDTTGITTPPANADSVEQKFPPVDEQMKDPLSLYNYYKRAVRIRNENPEIARGDMSVIEELCTKDISAIKKVYQGSEIVILYNINTESANILLKDAGLTELNIRGYLSVDGNAVTMSDGVVSMPKYSIVILK

SEQ ID NO: 94 - protein, 583 aa, Clostridium phytofermentans
MKFEAIYHRTSDNYCYPLNEEDLIINIKTGHDIERVFIYYGDPFEGGILGGNWTWNGVEEELIYKKNLTHHIWWTTTVKPKFKRCKYYFKLVANDTSYYYFEDGFYTEAEMNHQDKNLVYFTFPWMNSIDINKTPDWVNDTVWYQIFPERFNNGDKENDPKNVKAWGFHTVSNDEFYGGDLQGIINRLDYLADIGISGIYLTPIFEANTSHKYDTKDYMKIDPHFGDEKVFKNLVDTAHEKGIRIMLDGVFNHCGNQFAPWLDVLKNGPDSKYFNWFMINKWPFNKEDHNTNDGSFYSFAFTSRMPKLNTNNPEVIKYLLDVVEYWVKNFDIDGIRLDVANEISHRFCKDLRKLTKELKPDFYILGELWHDAITWLHGDEFDGVMNYPLATSLADYWVYPEKTNYDFECAINHNFTMYMQQTNDVLFNLLDSHDTNRLIDKVKDIDIFYQQLAVLFTMPGSPCIYYGTEIAMEGSYDPDCRRCMPWEDIDAGLFKDRIEIIKALIHLRKTNNAFKSRHYHFIEDKNNNRVIHYIKTDEDHKQVEVILNCSKDSIVVQRKGNELFSLLNEDTILKPKGVFIQQI

SEQ ID NO: 95 - protein, 575 aa, Clostridium thermocellum
MKLEAIYHKPYSEFAFPVAPDTLVIRLRTAKNDVNTCILIYHEKYDTSQRGKVKMDKVASDGMFDYYEVELNVGIKRIKYMFYLEDNYSIKWYSSDGFFDYMPQWGHFTYSYICKDDIFHEVEWFRNSTIYQIFPDRFAKFPPDTENSGKRTIHGGNIKGIIDRFDHLVKLGVDVVYLNPIFKSESYHRYDVVDYYEIDPMFGSKEELRELMDLCHKNGIKVIFDGVFNHSGDKFFAFRDVVEKGEKSKYANWYFINSFPVQGYPRPNYECFSFYGGMPKLNTGNPETAKYFLDVVKYWTVEFGVDGWRLDAADEVDRKFWRKLRDMLKDLNKDVVLIGEIFDEASSWLWGDQFDSVINYPLKAMINDLFAYRSIDVETFRNRISGYIMKFNKKVLSSLVNIISTHDTPRFLTLCNGDEKRFEMAVVFQFTFPGVPLIYYGDEIGMEGEGDPDCRRPMIWDEAKWNKKTLELYKFLIGLRKRFDALRTGEYGELPVTGCNGILAYRRGRGENGIIVAMNTLDRKENVVVETGDSFDTVKAFESLKDEERLNVDKKRINICLNPFEWRIYKACGEL

SEQ ID NO: 96 - protein, 655 aa, Thermobifida fusca
MIGRFPILDVSPVVDIGTAKAVVGETFPVRATVFREGHEALGAGVVLYTPEGQRQPLVPLREIAPGTDRYEAEVTVTSEGLWHFAIEAWSDPYATWCHDARIKIPAGQDVELMLEEGARLLERAARRVPRRPALAEIAAAMRDGSRSAHERLDLALSDLVRDELAERPLRELVTRSQRFPVMVSRRRALFGSWYEFFPRSEGAVLDTEDGEPRSGTFATAARRLPAIADMGFDVVYIPPIHPVGYSFRKGRNNSTVAQPGDPGSVWAIGSHEGGHDAIHPDLGTIDDFDAFVARARELGLEIAMDLALQASPDHPWVKEHPEWFTVRADGSIAYAENPPKKYQDIYPINFDKDPEGIFTEVRRIVRYWMSHGVRIFRVDNPHTKPVAFWERLLADIAATDPDVIFLSEAFTRPAMMHTLAKIGFHQSYTYFTWRNTKQELEEYLTELTGEAAAYMRPNFFVNTPDILHAYLQHGGRPAFEVRAILAATLSPTWGMYSGYELCENRALKPGSEEYLDSEKYQYKPRDWEAAEAAGITITPLIRKLNSLRRSHPALQELRNLRFHYADQPEIICYSKRLAGANHGADDTILVVANLDPHHTREATVWLDMPALGFAPGDHITVTDQLSGHSYHWVEANYVRLDPHVQTAHIFTVAPA

SEQ ID NO: 97 - protein, 572 aa, Thermobifida fusca
APSGNRDVIVHLFQWRWKSIADECRTTLGPHGFGAVQVSPPQEHVVLPAEDYPWWQDYQPVSYKLDQTRRGSRADFIDMVNTCREAGVKIYVDAVINHMTGTGSAGAGPGSAGSSYSKYDYPGIYQSQDFNDCRRDITNWNDKWEVQHCELVGLADLKTSSPYVQDRIAAYLNELIDLGVAGFRIDAAKHIPEGDLQAILSRLKNVHPAWGGGKPYIFQEVIADSTISTGSYTHLGSVTEFQYHRDISHAFANGNIAHLTGLGSGLTPSDKAVVFVVNHDTQRYEPILTHTDGARYDLAQKFMLAHPYGTPKVMSSYTWSGDDKAGPPMHSDGTTRPTDCSADRWLCEHRAVAGMVGFHNAVAGQGIGSAVTDGNGRLAFARGSAGYAAFNATNTAWTRTFTTSLPDGVYCDVANGTFVDGVCDGPSYQVSGGKFTATVPANGAVALHVEAPGSCGPDGCGTPPGGGDDCTTVTARFHATVTTWYGQEVAVVGSIPELGSWQPAQGVRLRTDSGTYPVWSGAVDLPAGVGFEYKYVKLNPDGTVEWEQGGNRIATVDDSGGGCSQNFYDSWR

SEQ ID NO: 98 - protein, 825 aa, Anaerocellum thermophilum
MLVRAYIDDFNEIVVVLSQMVHSVKKEDFKVFLNEEEIDIEKIDKIIPHSDNPAEAETRGYEICEQKGKIRFVLKEGHFDYHRKPYKKPVFVIGEMNDWQISPEWEMTYSKLRGRYELIKDLKEIKIGQKFKFAEGASQKLWYPPGFGNDIVITEYFDRETAFTNMIRIIPSNRLLPNLKYKVVYKSEHIWARPREILTRPEFFYPGELGIKYEPYGTYFKLWAPTAYKVKVKVFDESENFRFEKEMARSENGTWNIYLTGDLKNHYYLYEVWHYNYDEDEGFIVYEVPDPYSKASSSNSQKSFIFDPADTLIEGWQQDEFVKTIEKQQDAIIYEMHVRDFTIDKNSGVDEKFRGKFLGLCQKSFYKEKFSTGLLHLKELGITHIHLLPISDFGSVDDKNPDKKYNWGYDPVLYQCPEYWYSTKSGGIEALKELKTMIKTLHQNGIGVVMDVVFNHTYHTKGGKFSIFDKIVPGYFYRIDDYGDYSNATGCGNEIATEKPMVRKFILDTIIYWTEDFHIDGFRFDLMGLIDTLTMRMIAKEVRKRNPYALIYGEGWVMGDSMCLLEERATIESTAHHGYSIGLFNDRIRDSIRGDLDGFKTGYMHGNLSDIERLKQGIRAAIDDFAKEPDECVNYVSCHDNLTLFDKAQKTMVGEDIFWIDRVCRLANAIILTSQGIPFLHGGVEFNRSKGGHPNTYNAGDNINKIDWSLKEKFYDTFKFYCDLIKLRKEHVAFRMRSSGEIRKYLKFLPAPDGIVAFLISYPYDAWKKIIVAYNPFKEKKVITLPEGVWKIKANDGIIFSEENELEAIGSFEISPVSLFIAYQK

SEQ ID NO: 99 - protein, 1104 aa, Anaerocellum thermophilum
DEKTTLIIHYYRYNEDYQGWNLWIWPVEPVGAEGKAYEFTSKDDFGVKAVVELPGKVTKVGIIVRKGNWEAKDVAVDRFISGISGSKEVWLIEGEEQIYTSQPQKTPKMTAFIDGLNTIVVKLAKKADILSNNRTQGFKVTAFYEEVPIKKVEPVLPKINKNFKPEEAGYELIDGGTKVKFILKPGAGDFKFTDTSGKLDVYVSGTMNDWGGTASSEGKYKPLPAWKMTWNAEKGYYELVKELGKDGVVIGAKFKFTSWDGTSAKWYPDGMGNDKVIEELYTGNEKITKVDTFKITTEDELEPQVPYVVSKDSFKPTVAQARNILDNPKYYYKGNDLGCTYTKAYSAFRLWAPTAIGVILRLYDDYKTTKYKEYEMQQSFNGTWYLKINGDLKGKYYQYEVWHASNSITDDTIRKYVVPDPYSRATSANSERTLIFDPKDTNPVGWEKDTFVTLKNQEDAIIYETHVRDFTIDASSGVRPEFRGKYLGFTQTGAKGPNGVKTGIDHLKELGITHVHLLPTYDFGSIDETNPDKGYNWGYDPVLYQNVEGSYATNPNTIVRIKEYKQMVMALHKAGIGIIQDVVFNHTFQIGDAKFSIFDKIVPGYFYRKDKDGNYSNASGCGNEIATEKPMVRKFIIDTLTYLTKEYHIDGFRFDLMAAIDRVTMAKAQEEVRKINPSAVIYGEGWLAGSTPLDSSLRMEIGSFNQAGLHIGLFNDRIREAIRGNLDNESKGFMQGNYSFRLEDLKRGIQGGLGDFAADPDECINYVSAHDNLTLWDKLQKSVPNEPDYIKDKMGRLANAIVLTAQGVPFLHGGVEFNRTKYMNHNSYNAGDKINKYNWNLKVKWYNTFKYYQGLIALRKAHPAFRMTTAEDIQKYLTFIQTPKGTLGFRLTYPKDTWNDIIVVYNSTKKVQEVTLPEGNWVVVANGDEVGTTPIKNLTNFVAGKALVAPISMFVAYKSNEFPQGFTKVTGKDPVSLESSSTVTVPKVYGNGNIEVTFKVKVPHGTDDDVIYLAGSFGKAGLSDWNPGDKDGAIELVRLQDGTYTVTVKLNAGETFEYKYTRGSWTTVEKGANKEEIENRKLTVKDEGGGKMIVSDTVLNWADK

SEQ ID NO: 100 - protein, 611 aa, Anaerocellum thermophilum
MRKPHIIEAIIGNTKVLGQLDSNGILQRFYWPAVDYYQQLKLFLAAVFLDGLVFFEDENFKIKSGFVDDFVYFFEYKIADKTIFQLDFVDFETDSLVRLWETGFEDFYVFLEPMINSSSLFNAAKVDKENEIVYAYFKGTYIGLAFENKIKSFTVKNGIDDANDNQLEGWNEATNPQIAVKLKNTGKVVCFLAFGNSKDEIYQKLSYLKQKGYDEVYRQNKAFWEKKFSKVKLICTQDPKDMQLQKRSAYVFYVLQNSKTGGILAASEVDEKFFHCGGYGFVWGRDAAFIVSAMDELGLSREVEKFFGFKFSCQEKEGFWDQRYYTDGSLAPSWGIQIDETASVVWGFLEHCEKQNSLHLIDLHKEQLKKALLFLIAAVDSEKGVIFRSFDLWEEREGIHLYSNASIYAALKKAKKYFPELESEIEKKLKAIKNQMATRFYSPKLSRYVRSTDVRIPHEEFLKLPEENRYMQKDERYEITYYFKKQDEVVDISMLGIYYPFEMVDSSDKAFKATILAIERECQNSIVGGYKRYSDDRYIGGNPWILTTLWLAIYYKKTGQIDRAEKLFEWAKAHSLPNGLFPEQVDRITGKPAWVVPLAWSHAMYVLYLYE

SEQ ID NO: 101 - protein, 529 aa, Streptomyces avermitilis
MTSFRPAPAWLADAVFYQIYPQSFADSDGDGIGDFNGIVQRLDHLVWLGVTAVWLNPCFVSPFRDAGYDVSDYLNVAPRYGSADDLAELVDEAGRRGIRVLLDLVAGHTSDEHPWFTASANDPDDHRYIWAPEGRPDGFVTSPGTRPGAYLPNFFDTQPALNFGYGRKNPAEPWRQPVDAAGPRANREALRTIMDHWLGLGLAGFRVDMAASLVKDDPGRTETARIWTELRHWLDTAHPDAVLLSEWGEPEVSVPAGFHTDFFLQFGGATDGLPLRSLWSNGDGTVNEAWDPLDCFFDASGKGSPRPFVEAWRKASDAVGATGFVSLPTANHDFSRLNCGPRTAEQLPAAFAFQLTWPTLPAIYYGDEIGMRYVGGLPDKEGSVLGPRYNRAGSRTPMQWDDGPGAGFSTAPADRLYLPLDPSPDRPTVAAQRADDGSLLHLVRRLVALRASTPALGSGGSVEVLHTGYPFVYVRGGRYLVVVNPQRNEVRCPYDATREARALEASGVRVGNGTIEAEGFSYGVFDLGR

SEQ ID NO: 102 - protein, 431 aa, Streptomyces avermitilis; identical to SEQ ID NO: 88

SEQ ID NO: 103 - protein, 503 aa, Saccharomycopsis fibuligera
LPLQEGPLNKRAYPSFEAYSNYKVDRTDLETFLDKQKDVSLYYLLQNIAYPEGQFNDGVPGTVIASPSTSNPDYYYQWTRDSAITFLTVLSELEDNNFNTTLAKAVEYYINTSYNLQRTSNPSGSFDDENHKGLGEPKFNTDGSAYTGAWGRPQNDGPALRAYAISRYLNDVNSLNKGKLVLTDSGDINFSSTEDIYKNIIKPDLEYVIGYWDSTGFDLWEENQGRHFFTSLVQQKALAYAVDIAKSFDDGDFANTLSSTASTLESYLSGSDGGFVNTDVNHIVENPDLLQQNSRQGLDSATYIGPLLTHDIGESSSTPFDVDNEYVLQSYYLLLEDNKDRYSVNSAYSAGAAIGRYPEDVYNGDGSSEGNPWFLATAYAAQVPYKLVYDAKSASNDITINKINYDFFNKYIVDLSTINSGYQSSDSVTIKSGSDEFNTVADNLVTFGDSFLQVILDHINDDGSLNEQLNRNTGYSTSAYSLTWSSGALLEAIRLRNKVKALA

SEQ ID NO: 104 - protein, 497 aa, Saccharomycopsis fibuligera
VPVELDKRNTGHFQAYSGYTVARSNFTQWIHEQPAVSWYYLLQNIDYPEGQFKSAKPGVVVASPSTSEPDYFYQWTRDTAITFLSLIAEVEDHSFSNTTLAKVVEYYISNTYTLQRVSNPSGNFDSPNHDGLGEPKFNVDDTAYTASWGRPQNDGPALRAYAISRYLNAVAKHNNGKLLLAGQNGIPYSSASDIYWKIIKPDLQHVSTHWSTSGFDLWEENQGTHFFTALVQLKALSYGIPLSKTYNDPGFTSWLEKQKDALNSYINSSGFVNSGKKHIVESPQLSSRGGLDSATYIAALITHDIGDDDTYTPFNVDNSYVLNSLYYLLVDNKNRYKINGNYKAGAAVGRYPEDVYNGVGTSEGNPWQLATAYAGQTFYTLAYNSLKNKKNLVIEKLNYDLYNSFIADLSKIDSSYASKDSLTLTYGSDNYKNVIKSLLQFGDSFLKVLLDHIDDNGQLTEEINRYTGFQAGAVSLTWSSGSLLSANRARNKLIELL

SEQ ID NO: 105 - protein, 747 aa, Saccharomyces cerevisiae
FPTALVPRGSSSSNITSSGPSSTPFSSATESFSTGTTVTPSSSKYPGSKTETSVSSTTETTIVPTTTTTSVITPSTTTITTTVCSTGTNSAGETTSGCSPKTITTTVPCSTSPSETASESTTTSPTTPVTTVVSTTVVTTEYASTSTKQGGEITTTFVTKNIPTTYLTTIAPTSSVTTVTNFTPTTITTTVCSTGTNSAGETTSGCSPKTVTTTVPCSTGTGEYTTEATAPVTTAVTTTVVTTESSTGTNSAGKTTTSYTTKSVPTTYVFDFGKGILDQSCGGVFSNNGSSQVQLRDVVLMNGTVVYDSNGAWDSSPLEEWLQRQKKVSIERIFENIGPSAVYPSILPGVVIASPSQTHPDYFYQWIRDSALTINSIVSHSADPAIETLLQYLNVSFHLQRTNNTLGAGIGYTNDTVALGDPKWNVDNTAFTEPWGRPQNDGPALRSIAILKIIDYIKQSGTDLGAKYPFQSTADIFDDIVRWDLRFIIDHWNSSGFDLWEEVNGMHFFTLLVQLSAVDRSLSYFNASERSSPFVEELRQTRRDISKFLVDPANGFINGKYNYIVETPMIADTLRSGLDISTLLAANTVHDAPSASHLPFDIDDPAVLNTLHHLMLHMRSIYPINDSSKNATGIALGRYPEDVYDGYGVGEGNPWVLATCAASTTLYQLIYRHISEQHDLVVPMNNDCSNAFWSELVFSNLTTLGNDEGYLILEFNTPAFNQTIQKIFQLADSFLVKLKATWEQTGN

SEQ ID NO: 106 - protein, 621 aa, Aspergillus niger
NVISKRATWDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEVNGSSFFTIAVQHRALVEGSAFATAVGSSCSWCDSQAPEILCYLQSFWTGSFILANFDSSRSAKDANTLLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDATGTYSSSSSTYSSIVDAVKTFADGFVSIVETHAASNGSMSEQYDKSDGEQLSARDLTWSYAALLTANNRRNVVPSASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 107 - protein, 593 aa, Aspergillus oryzae
VQPVLRQATGLDTWLSTEANFSRQAILNNIGADGQSAQGASPGVVIASPSKSDPDYFYTWTRDSGLVMKTLVDLFRGGDADLLPIIEEFISSQARIQGISNPSGALSSGGLGEPKFNVDETAFTGAWGRPQRDGPALRATAMISFGEWLVENSHTSIATDLVWPVVRNDLSYVAQYWSQSGFDLWEEVQGTSFFTVAVSHRALVEGSSFAKTVGSSCPYCDSQAPQVRCYLQSFWTGSYIQANFGGGRSGKDINTVLGSIHTFDPQATCDDATFQPCSARALANHKVVTDSFRSIYAINSGRAENQAVAVGRYPEDSYYNGNPWFLTTLAAAEQLYDALYQWDKIGSLAITDVSLPFFKALYSSAATGTYASSTTVYKDIVSAVKAYADGYVQIVQTYAASTGSMAEQYTKTDGSQTSARDLTWSYAALLTANNRRNAVVPAPWGETAATSIPSACSTTSASGTYSSVVITSWPTISGYPGAPDSPCQVPTTVSVTFAVKATTVYGESIKIVGSISQLGSWNPSSATALNADSYTTDNPLWTGTINLPAGQSFEYKFIRVQNGAVTWESDPNRKYTVPSTCGVKSAVQSDVWR

SEQ ID NO: 108 - protein, 579 aa, Rhizopus oryzae
ASIPSSASVQLDSYNYDGSTFSGKIYVKNIAYSKKVTVIYADGSDNWNNNGNTIAASYSAPISGSNYEYWTFSASINGIKEFYIKYEVSGKTYYDNNNSANYQVSTSKPTTTTATATTTTAPSTSTTTPPSRSEPATFPTGNSTISSWIKKQEGISRFAMLRNINPPGSATGFIAASLSTAGPDYYYAWTRDAALTSNVIVYEYNTTLSGNKTILNVLKDYVTFSVKTQSTSTVCNCLGEPKFNPDASGYTGAWGRPQNDGPAERATTFILFADSYLTQTKDASYVTGTLKPAIFKDLDYVVNVWSNGCFDLWEEVNGVHFYTLMVMRKGLLLGADFAKRNGDSTRASTYSSTASTIANKISSFWVSSNNWIQVSQSVTGGVSKKGLDVSTLLAANLGSVDDGFFTPGSEKILATAVAVEDSFASLYPINKNLPSYLGNSIGRYPEDTYNGNGNSQGNSWFLAVTGYAELYYRAIKEWIGNGGVTVSSISLPFFKKFDSSATSGKKYTVGTSDFNNLAQNIALAADRFLSTVQLHAHNNGSLAEEFDRTTGLSTGARDLTWSHASLITASYAKAGAPAA

SEQ ID NO: 109 - protein, 644 aa, Clostridium thermocellum
MANTYFNDAIIGNSGMLVCLTRNGELTRLFWPNIDYPQHFEKMATGIFYTGQKNSTSWFYEDNWHHTQYYVEDTNILKTICEDGGRGLRVEQTDFVLKDRDVMVRRYVIENIGPNEVDLGFVQYSSTVSTTPELRSTLFDFNVDALIHYRHNYYISISSDSEVVQFQLGNNAFDCARYTELYGYDSIGMMKDGAMSFNIGKIEPGGKKTFNLFICASHTLKGVKELVRWCRKMNVDEEYEKTRKYWLDFLKNARLIVTGDKNIDNLYKRSILVFKLMSDERTGGLLASAEIDEGFTRCGRYAYCWGRDAAFITGALDTAGLTEAVDKFYQWAVMTQDDDGSWQQRYHMDGNLAPSWGLQIDETGTLIWGMLKHYEVTKNIDFLKSMWESIKKGVEFLTRFIDSDTGLPAPSYDLWEERVGEHTYSSAAVYAGIKAGAEAARILGASEELIEKWEKAASDMKASIEKNFWRDEAGRFIRSVRTKLNPWGSEHSPYTTVIKVNEKGYFRDVTLEDWTIDVSLLGVSIPFGVFDVHDERVKKTVEAIERALTSHPVGGIKRYENDNYIGGNPWVLATLWVALYYIEIKEYEKAKDYLRWATKSCTALGLLPEQVSKDNGEPCWVIPLTWSHAMYVLVLAGLKEAGVL

SEQ ID NO: 110 - protein, 644 aa, Clostridium thermocellum
MQKSYYNNAITGNSSMLACFSERAELLRLFWPDIDYIQNLDKMFLGLFEKNKTGSTVWLNDIRCEHHQEYLPDSNIIKNMVTNFFDGYKVVLYDFVHPEMDVLVRRFEIENLRGESRELGLMSFSAATSSDSEVACSLFDFMNEALVHYKPDSYIAVTSDIPVYQFQIGNNANDAAVNTYLYGKDDIGMMKDAAISWDLGVFQPHAVKTTNVYLCAADTLKSCKALVRRVKTVGGLTAFRETGRYWKDYLEKTTKLKSGNTLLDDLYKRSLLVFRLMYSKKSGGLMAAPEVDEYFTKCGKYAYCWGRDAAFITGALDIGGLCESVDHFYKWAVNVQDEDGSWQQRYHMNGNLGPCWGLQVDETGTIIWGMLNHYNYTKNTDFLKSVWDSVKAAADFLVRFIDSETGLPRPSFDLWEERYGEHAYSSASVCAGLKSASEMARILGKPSQEYIQWETTADSIKKAIVKYFWKEDYRRFIRSIRVKLNGFGQEPSSDTMLIKVNPKGYVRDVTKEDWIVDVSLVGLGIPFEIFELNDPMLRDTVSLIEQVLTAQGVGGIKRYENDTYIGGNPWILTTLWIALYHAKSGNYKKAKEYLIWAASGKTELGLLPEQINRDTGKPEWIIPLTWSHAMYVHVYSELINAGVL

SEQ ID NO: 111 - protein, 608 aa, Arxula adeninivorans
DSCHTFTLANSPPDDKAVALSSYSYCGGYLSASAFVKNLSYDKLVTLYWTNADNKSTPLNAGSLDYVKAASDDQSWELWSLNVTTVPDGVDALLNITYVAASIGKTNSQQLNVQVEATGDPIPTPQIPTIYKPYASPSDFSDDITNWLKPSNDSQTGIAKSFLFNNINIPGAAPGTVIAAQSYSEPDYAYTWVRDASLVMDVVNRLYSSAKSEEKRQLYEKILFQYAKAGAQEQNDPTAISGMGEPKFYLNNTAFTGSWGRPQNDGPATRAITLIEFANAYLANGGSQDTVREQLYDSDKYPQVAPIKKDLQFVASNWSSPSFDLWEEEESAHFYTRLVQRKALLLGADFANDMGDHELSDKLKTQASKLSDTLPEFWDSARQLILYEYGPVLRGKYSYKDISVVLGVMHGYANDNVFSYTNDQILATAYQVSTSFLDVYKVANTTSDESGKPLGIPVGRYPEDVYDGVGTSQGNPWYLTTMAMAEFLYRSVQEFEDAGSIIISDTSLPFWKYFASSVDHKAGAKYNKNDQSFKTSLKSLTGWGDAFMRRAKYHTPSSGHMSEEFNRTTGEPRGAKDLTWSYASLLSAAFAREELRNQKNYLTNVADL

SEQ ID NO: 112 - protein, 595 aa, Hormoconis resinae
APTELKARDLSSFIASERAIALQGALNNIGPDGSAVPGAGAGFVVASPSKANPDYFYTWSRDSALTLKMIIDEFILGNTTLQTIIEQYIHAQAVLQTVSNPSGTFLPDGVGLGEPKFMVDGTRFNGPWGRPQRDGPALRAIALMTYSNWLIKNGQFAEAKTKIWPIIANDLSYVGQYWNQSGFDLWEETYASSFFTIQNQHRALVEGAQLAHDLGVTCTGCDQAPEVLCFLQSFWNGKYIVSNINVNNGRTGLDGNSILGAISTFDIDAYCDSPTLQPCHSQSLANFKVLTDTFRNLYTINAGIPEGQGVAVGRYAEDVYMGGNPWYLITTAAAEFLYDAVAQWKARHVLTVDETSLAFFKDIYPEVTVREYKSGNANSPFAQIMDAVTAYADSYVAIAEKYIPSNGSLSEQFNRDTGTPLSAIDLTWSYAAFITMSQRRAGQYPSSWGSRNALPPPTTCSASSTPGIYTPATAAGAPNVTSSCQVSITFNINATTYYGENLYVIGNSSDLGAWNIADAYPLSASAYTQDRPLWSAAIPLNAGEVISYQYVRQEDCDQPYIYETVNRTLTVPACGGAAVTTDDAWMGPVGSSGNC

SEQ ID NO: 113 - protein, 601 aa, Aureobasidium pullulans
LPSPESIQERATGSLSSWLSSENTVALQGVLNNIGASGSKASGASAGVVVASPSKSNPDYFYTWTRDSALVFKALVDQLIAGNKSLEPLIQQYISAQAKLQTVNNPSGGLCSGGLAEPKFEVDLTPFTGAWGRPQRDGPALRATAMIAYSRYLIANGNTTTVNNIIWPIVQNDLSYVTQYWNQTTFDLWEEINSSSFFTTAVQYRALVEGNNLATQLGKSCPNCVSQAPLVLCFLQSYWTGSYALSNTGGGRSGKDANSILTSIHIFDPAASCDSTTFQPCSDKALANHKVVTDSFRSIYSINQGIAQGSGVAVGRYPEDSYYNGNPWYLNTFAAAEQLYDAVYQWKKIGSISITSISLPFFKDVYSSAAVGTYSSSTVTFTSIVNAVQTYADSYMSIAQKYTPSNGALSEQYNRADGTPLSAVDLTWSYAAFLTAYNARANVLPASWGASSAKLPNSCSSGSATGPCAAATNTNWGNPGSPSTGTPTTTTGGSCTTPTSIAVTFNEQKTTSYGENIYIVGSIPALGNWNTANAVALSASKYTSSNPLWTVTINFATGTSFNYKYIKKAQDGSVTWESDPNRSYTVTGNCAGTATENDSWR

SEQ ID NO: 114 - protein, 718 aa, Bacillus subtilis
MVSIRRSFEAYVDDMNIITVLIPAEQKEIMTPPFRLETEITDFPLAVREEYSLEAKYKYVCVSDHPVTFGKIHCVRASSGHKTDLQIGAVIRTAAFDDEFYYDGELGAVYTADHTVFKVWAPAATSAAVKLSHPNKSGRTFQMTRLEKGVYAVTVTGDLHGYEYLFCICNNSEWMETVDQYAKAVTVNGEKGVVLRPDQMKWTAPLKPFSHPVDAVIYETHLRDFSIHENSGMINKGKYLALTETDTQTANGSSSGLAYVKELGVTHVELLPVNDFAGVDEEKPLDAYNWGYNPLHFFAPEGSYASNPHDPQTRKTELKQMINTLHQHGLRVILDVVFNHVYKRENSPFEKTVPGYFFRHDECGMPSNGTGVGNDIASERRMARKFIADCVVYWLEEYNVDGFRFDLLGILDIDTVLYMKEKATKAKPGILLFGEGWDLATPLPHEQKAALANAPRMPGIGFFNDMFRDAVKGNTFHLKATGFALGNGESAQAVMHGIAGSSGWKALAPIVPEPSQSINYVESHDNHTFWDKMSFALPQENDSRKRSRQRLAAAIILLAQGVPFIHSGQEFFRTKQGVENSYQSSDSINQLDWDRRETFKEDVHYIRRLISLRKAHPAFRLRSAADIQRHLECLTLKEHLIAYRLYDLDEVDEWKDIIVIHHASPDSVEWRLPNDIPYRLLCDPSGFQEDPTEIKKTVAVNGIGTVILYLASDLKSFA

SEQ ID NO: 115 - protein, 710 aa, Bacillus licheniformis
MPGISRPFEAYLDEMRTITVLVPKSRASSCSPPFLLEDDQGERIELSVKAQVELEEQFKYVLESSCTVPFGRVHKVCCEESVWTDLQIGSVTRSAAFDKAFFYDGRLGAFYSKGSTLFKVWAPTASAAAIKLEDPDSLQTNTFQMMRRKKGVFEVTVEGDLNGWSYLYELYVNGKPLLTVDPYAKAVTANGEKGVVLDPEEVKVEKHRAPRLHSPCDAVIYEVHIRDFSIHEDSGMRHKGKYVAFTEDGTETSGGFSTGIAYLKELGVTHIEVLPFHDFAGVDELSPDQSYNWGYNPLHFNAPEGSYSLDPQNPKCRITELKTMIQSLHKHGFSVIMDAVYNHVYKRETSPFEKTVPGYFFRHNEYGFPSDGTGVGNDIASERLMVRKYILDSVRYWLEEYDVDGIRFDLMGILDIETVRQISTLAENVKPGVPLFGEGWDLNTPLDSGQKATLQNAGKVPAVGFFNDRFRNAVKGSTFELSDRGYALGDTGKKAALQHGIAGSPGFLQPAQSINYVECHDNHTFWDKMALCFEEDADTKRLRQRLAVSIVLLSQGVPFLHAGQEFCRTKNGDSNSYRSGDDINKLDWEKRAELCEDVEYVRQLIRLRRSHPAFRLQKEEEVKEHLSFMDGTGEVTAYKLKNIAAIDPWNEIIVVHCPFAKKETLKLPDQKQYLLHCDPFTFFNGKVQAEKRLRLNGIGTYVLYEPKGIF

SEQ ID NO: 116 - protein, 918 aa, Oryza sativa
MAVGEECAAAVASQGFVSDARAYWVTRSLIAWNVNDQDTSLFLYASRDATMHVSDGAIHGYDSKIELEPEHASLPDNVAEKFPFIRSYRTFRVPSSVDVTSLVKCQLAVASYDAHGRHQDVTGLQLPGVLDDMFAYTGPLGAVFSDKDVDLYLWAPTAQDVRVCFYDGPAGPLLQTVQLKELNGVWSVTVPRYRENQYYLYEVKVYHPSTSQVEKCLADDPYARGLSANGTRTWLVDINSETLKPASWDELSDEKPNLESFSDISIYELHIRDFSAHDSTVDCNSRGGFRAFTFQDSAGIRHLRKLSAAGLTHVHLLPSFHFASVDDNKSNWKFVDEAQLAKLPPGSDEQQAAIVSIQQEDPYNWGYDPVLWGVPKGSYASNPDGPSRIIEYRQMVQALNRIGLRVVMDVVYNHLDSSGPFGVSSVLDKIVPGYYLRRNVNGQIENSAAMNNTASEHFMVDRLIVDDLLNWAINYKVDGFRFDLMGHIMKSTMFTVMSICTISTIIKIKDVFADTLIRAKSAIRSLTRDVHGVDGSKIYLYGEGWDFGEVAQNKRGINASQINMSGTGIGSFNDRIRDSVNGGNPFGNPLQQGFSTGLFLEPNGYYQGNEADTRRELATYADHIQIGLAGNLKDYVLRTHTGEAKKGSDIYTFDGSPVGYTSSPVETINYVSAHDNETLFDIVSIKTPIGLSIDEKCRINHLASSMIALSQGIPFFHAGDEILRSKSLDRDSYNSGDWFNKLDFTYETNNWGVGLPPRDKNEENWHLIKPRLENPSFRPLKNHILSVFDNFVDILKIRYSSPLFRLSTASDIEQRVRFHNTGPSMVPGVIVMSIKDAQNEKCKMAQLDKNFSYVVTIFNVCPHEVSIEIHDLASLGLELHPIQVNSSDALVRQSAYEASKGRFTVPRRTTAVFVQPRC

SEQ ID NO: 117 - protein, 963 aa, Triticum aestivum
MPMPMRTMLLRHLSPAPALPNPRRSSASSPQRRPARARPPPLHSARATALRARRTPMAAGETGASVSVSAAEAEAEATQAFMPDARAYWVTSDLIAWNVSEQEAASVYLYASRTAAMGLSPSNGGIQGYDSKVELQPESAGLPETVTQKFPFISSYRAFRVPSSVDVASLVKCQLVIASFGADGKHVDVTGLQLPGVLDDIFAYTGPLGAVFREDSVSLHLWAPTAQDVSVCFFDGPAGPVLETVQLKESNGVWSVTGPREWENRYYLYEVDVYHPTKAQVLKCLAGDPYARGLSANGARTWLVDINNETLKPASWDELADEKPKLDSFSDITIYELHIRDFSAHDGTVDSDSCGGFRAFAYQASAGMQHLRKLSDAGLTHVHLLPSFHFAGVDDIKSNWKFVDECKLATFPPGSDMQQEAVVAIQEEDPYNWGYNPVLWGVPKGSYASDPDGPSRIIEYRQMVQALNRIGLRVVMDVVYNHLDSSGPCGISSVLDKIVPGYYVRRDTNGQIENSAAMNNTASEHFMVDRLIVDDLLNWAVNYKIDGFRFDLMGHIMKHTMMRAKAALQSLTRDAHGVDGSKIYLYGEGWDFAEVARNQRGINGSQLNMSGTGIGSFNDRIRDAVNGGNPFGNPLQQGFNTGLFLEPNGFYQGNEADTRRSLATYADQIQIGLAGNLRDYVLITHTGETKKGSEIHTFDGLPVGYTSSPIEIINYVSAHDNETLFDVISVKTPMNLSVDERCRINHLASSMMALSQGIPFFHAGDEILRSKSIDRDSYNSGDWFNKLDFTYETNNWGVGLPPSEKNEDNWPLMKPRLENPSFKPAKGHILAALDSFVDILKIRYSSPLFRLSTASDIKQRVHFHNTGPSSVPGVIVMGIEDARDEKPEMAQLDANFSYVVTVFNVCPHEVSMDIPALASMRLELHPVQVNSSDALVGKSVYEAATGRFTVPRRTVSVFVEPRC

SEQ ID NO: 118 - protein, 647 aa, Clostridium phytofermentans
MDEFWNSIDGEKQYYYDGNDLGCTYTNRSTKLKVWAPTASMVVVNLYQNGNAGKPYITEIMKKEESGIWSVCLLGDLEGVYYTYLVTVDGQTKEAVDPYARTTGLNGKRAMILDLEKTNPTGFLEDTKPKFDSFLDAVIYELHIRDLSMESDSGIKEKGKLLGLTELNTRNSDGLTTGLSHILDLGVTHIHLLPCFDYASVDEENSSIFNWGYDPENYNVVEGSYSTNPYDGAVRVKEFKTLVQSLHENGLRVIMDVVYNHTMKTEESNFNKIVPDYYYRKVGDKFSDASACGNETASERLMVRKFIVDSIIYWAKEYHIDGFRFDLMGIHDIETMNEVRKVLDQIDPSIILYGEGWVGGDSPLPAGQRAMKANMSMLPGIAAFSDDFRDGLKGSVFLAEEKGFATGDSDKKESVKFGVVASTLHPQIDYKKVNYSDSPWALEPAQCINYVSAHDNYTLWDKIACSCKEDTYEIRVKKNKLCAAIVFTSQGIPFLQAGEEMLRNKPSSEIAGEFVENSYNSSDSVNCIKWSNKANVIDVVSYYEGLIRFRKEHKALRMQSAKEISKRLTFLPEEREDVISYLIQGDLVDKTLCVIYNSSEEKVTIRLPESDWTVYIDGNNSGVEPLYEVKGTTVEVEPISCMVLVKD

SEQ ID NO: 119 - protein, 1764 aa, Streptomyces avermitilis
ATPPAPPSDAKLAAEPARHDATREQFYFVMPDRFANGDTSNDKGGLTGSRLSTGYDPTDKGFYQGGDLKGLTRKLDYIKGLGTTSIWLAPIFKNQPVQGTGKDASAGYHGYWITDFTKVDPHFGTNKDLETLISKAHAKGMKVFFDVITNHTADVVDYEEKSYGYLSKGAFPYLTKDGRPFDDAGYTDGPRKFPAVDGDSFPRTPAVAARKKNAKVPSWLNDPTMYHNRGDSTFAGESSTHGDFSGLDDLWTERPEVVRGMEKIYEKWVRDFGIDGFRIDTVKHVNTEFWTQWATALDAYAKKRGKDDFFMFGEVYSADTSVTSPYVTQGRLDSTLDFPFQDAARSYASQGGSAKKLASVFGDDYKYTTDKANAYEQVTFLGNHDMGRIGYFLNQDNPKATDAELLRKDRLANELMFLSRGNPVVYYGDEQGFTGSGGDKDARQTMFASKVADYLDDDEIGTDRGHASDAYDTSAPLYKEIAALSKLRKDNPALADGIQTERYAADGAGVYAFSRTDARTGTEYVVAVNNADKASAATFATGSADTAFKGIHGTDDVLKSDADKKITVTVPAGAAVVLKAAGRPGTPAAKPSLTLKAPDAGATGTVELSADVDGGRLNRVVFAAQVGNAKWRTLGSADHAPYRVTQTIGKDVPAGTALRYKAVVIDAAGRTASATAASTTGTPPAAETPTASSRDYAIVHYKRPDGDYTDWRLYAWGDLADGESTTWPAGHDFVGRDAYGAFAYVKLKPGASTVNFLVIDKDGDKDVSADRTIDVTKAGEVWVEQGKETVRTERPDYPAQDKTKAVIHYHRADGDLTGWGLHVWTGAATPTDWSKPLEPVRTDAYGAVFEVPLTDGATSLSYIIHKGDEKDLSADRSLDLTADGHEVWLLNGQENHLLPQPAGSAAALDLTTSKAVWIDRNTVAWNGSDAAASTQLLSSRDGSIAVKDGSLTSDDERWLRLSKTSLTDAQKAAFPHLKSYTAWSVDPRDRDRVREALAGQVVASQRAANGAVLAATGVQLAGVLDDLYDATKADLGPTFRGGHPTLAVWAPTAQSVSLELDGAHVRMKRNNATGVWSVTGPASWKGKPYRYVVKVWAPTVRKVVTNKVTDPYSVALTTDSERSLVVDLDDRSLAPSGWSSLKKPKAVPLRDAEIQELHIRDFSVADRTVPAKDRGTYLAFTDKNSDGSRHLRQLAESGTSYVHLLPAFDIATIAEKKSGQQATDCDLASYAADSEKQQECLTAVAAKDAYNWGYDPYHYTVPEGSYATDANGTRRTVEFRRMVKSLNQDGLRVVMDVVYNHTAAAGQAGTSVLDRIVPGYYQRLLADGSVATSTCCANTATENAMMGKLVVDSLVTWAKEYKVDGFRFDLMGHQPKANILAVRKALDALTVAKDGVDGKKIILYGEGWNFGEVADDARFVQATQKNMAGTGIATFSDRARDAVRGGGPFDADPGVQGFGSGLYTDPNSSDANGTPAEQKARLLHYQDLIKVGLSGNLAKYRFTDSSGKEVTGSEVDYNGTGAGYADAPGDALAYADAHDNESLYDALTYKLPKGTPAGDRARMQVLAMATAALAQGPSLSQAGSDLLRSKSLDRNSYDSGDWFNAIHWNCQDGNGFGRGLPMAADNKSKWPYATPLLTSVKVGCDQIEGTSAGYQDLLRIRTTEPDFSLSTAGQVQSKLTFPLSGKDETPGVITMKLGDLVVVFNATPDQQEQTVAALAGKDYALHPVQAAGADPIVKSASYTAKSGMFAVPGRTVAIFSQVAR

SEQ ID NO: 120 - protein, 1079 aa, Klebsiella pneumoniae
SSSSPSGSPGSPGNPGNPGTPGTPDPQDVVVRLPDVAVPGEAAQASANQAVIHLVDIAGITSSTPADYATKNLYLWNNETCDALSAPVADWNDVSTTPTGSDKYGPYWVIPLTKESGCINVIVRDGTNKLIDSDLRVSFGDFTDRTVSVIAGNSAVYDSRADAFRAAFGVALADAHWVDKTTLLWPGGENKPIVRLYYSHSSKVAADSNGEFTDKYVKLTPTTVSQQVSMRFPHLASYPAFKLPDDVNVDELLQGETVAISAESDGILSSATQVQTAGVLDDTYAAAAEALSYGAQLTDSGVTFRVWAPTAQQVELVVYSADKKVVASHPMTRDSASGAWSWQGGSDLKGAFYRYAMTVYHPQSRKVEQYEVTDPYAHSLSTNSEYSQVVDLNDSALKPEGWDGLTMPHAQKTKADLAKMTIHESHIRDLSAWDQTVPAELRGKYLALTAQESNMVQHLKQLSASGVTHIELLPVFDLATVNEFSDKVADIQQPFSRLCEINSAVKSSEFAGYCDSGSTVEEVLTQLKQNDSKDNPQVQALNTLVAQTDSYNWGYDPFHYTVPEGSYATDPEGTARIKEFRTMIQAIKQDLGMNVIMDVVYNHTNAAGPTDRTSVLDKIVPWYYQRLNETTGSVESATCCSDSAPEHRMFAKLIADSLAVWTTDYKIDGFRFDLMGYHPKAQILSAWERIKALNPDIYFFGEGWDSNQSDRFEIASQINLKGTGIGTFSDRLRDAVRGGGPFDSGDALRQNQGVGSGAGVLPNELTSMTDDQARHLADLTRLGMAGNLADFVLIDKDGAVKKGSEIDYNGAPGGYAADPTEVVNYVSKHDNQTLWDMISYKAAQEADLDTRVRMQAVSLATVMLGQGIAFDQQGSELLRSKSFTRDSYDSGDWFNRVDYSLQDNNYNVGMPRSSDDGSNYDIIARVKDAVATPGETELKQMTAFYQELTALRKSSPLFTLGDGATVMQRVDFRNTGADQQTGLLVMTIDDGMQAGASLDSRVDGIVVAINAAPESRTLQDFAGTSLQLSAIQQAAGDRSLASGVQVAADGSVTLPAWSVAVLELPQGESQGAGLPVSSK

SEQ ID NO: 121 - protein, 546 aa, Rhizomucor pusillus
ATSDDWKGKAIYQLLTDRFGRADDSTSNCSNLSNYCGGTYEGITKHLDYISGMGFDAIWISPIPKNSDGGYHGYWATDFYQLNSNFGDESQLKALIQAAHERDMYVMLDVVANHAGPTSNGYSGYTFDDASLYHPKCTIDYNNQTSIEQCWVADELPDIDTENSDNVAILNDIVSGWVGNYSFDGIRIDTVKHIRKDFWTGYAEAAGVFATGEVFNGDPAYVGPYQKYLPSLINYPMYYALNDVFVSKSKGFSRISEMLGSNRNAFEDTSVLTTFVDNHDNPRFLNSQSDKALFKNALTYVLLGEGIPIVYYGSEQGFSGGADPANREVLWTTNYDTSSDLYQFIKTVNSVRMKSNKAVYMDIYVGDNAYAFKHGDALVVLNNYGSGSTNQVSFSVSGKFDSGASLMDIVSNITTTVSSDGTVTFNLKDGLPAIFTSAGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 122 - protein, 481 aa, Bacillus licheniformis
VNGTLMQYFEWYTPNDGQHWKRLQNDAEHLSDIGITAVWIPPAYKGTSQADVGYGAYDLYDLGEFHQKGTVRTKYGTKGELQSAIKSLHSRDINVYGDVVINHKGGADATEDVTAVEVDPADRNRVISGEHLIKAWTHFHFPGRGSTYSDFKWYWYHFDGTDWDESRKLNRIYKFQGKTWDWEVSNEFGNYDYLMYADIDYDHPDVVAEIKRWGTWYANELQLDGFRLDAVKHIKFSFLRDWVNHVREKTGKEMFTVAEYWSNDLGALENYLNKTNFNHSVFDVPLHYQFHAASTQGGGYDMRKLLNGTVVSKHPLKSVTFVDNHDTQPGQSLESTVQTWFKPLAYAFILTRESGYPQVFYGDMYGTKGDSQREIPALKHKIEPILKARKQYAYGAQHDYFDHHDIVGWTREGDSSVANSGLAALITDGPGGAKRMYVGRQNAGETWHDITGNRSEPVVINSEGWGEFHVNGGSVSIYVQR

SEQ ID NO: 123 - protein, 484 aa, Aspergillus niger
LSAAEWRTQSIYFLLTDRFGRTDNSTTATCDTGDQIYCGGSWQGIINHLDYIQGMGFTAIWISPITEQLPQDTADGEAYHGYWQQKIYDVNSNFGTADDLKSLSDALHARGMYLMVDVVPNHMGYAGNGNDVDYSVFDPFDSSSYFHPYCLITDWDNLTMVQDCWEGDTIVSLPDLNTTETAVRTIWYDWVADLVSNYSVDGLRIDSVLEVEPDFFPGYQEAAGVYCVGEVDNGNPALDCPYQKVLDGVLNYPIYWQLLYAFESSSGSISNLYNMIKSVASDCSDPTLLGNFIENHDNPRFASYTSDYSQAKNVLSYIFLSDGIPIVYAGEEQHYSGGKVPYNREATWLSGYDTSAELYTWIATTNAIRKLAISADSAYITYANDAFYTDSNTIAMRKGTSGSQVITVLSNKGSSGSSYTLTLSGSGYTSGTKLIEAYTCTSVTVDSSGDIPVPMASGLPRVLLPASVVDSSSLCGGSGRLYVE

SEQ ID NO: 124 - protein, 586 aa, Aspergillus tamarii
ATPADWRSQSIYFLLTDRFARTDGSTTAACNTEDRKYCGGTWQGIIDKLDYIQGMGFTAIWITPVTGQLPQHTAYGDAYHGYWQQDIYSLNENYGTADDLKALSSALHERGMYLMVDVVANHMGYDGAGASVDYSVFKPFNSQEYFHSFCLIQNYEDQTQVENCWLGDNTVSLPDLDTTKDEVKNEWYDWVGTLVSNYSIDGLRVDTVKHVQKDFWPGYNKAAGVYCIGEVLDGDPAYTCPYQDVMDGVLNYPIYYPLLNAFKSTSGSMNDLYNMINTVKSDCPDSTLLGTFVENHDNPRFASYTNDIALAKNVAAFIILNDGIPIIYAGQEQHYAGGNDPANREATWLSGYATDSELYKLIASANAIRSHAISKDTGFVTYKNWPIYKDDTTIAMRKGTDGSQVVTILSNKGASGDSYTLSLGDTGYKAGQQLTEVIGCTTVTVGSDGKVPVPMAGGLPRVLYPTEKLADSKICSSSGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 125 - protein, 603 aa, Acidomyces richmondensis
LTPAEWRAQSIYQVLTDRFALTNGSTTAPCNLNEYCGGTWQGIINKLDYIQGMGFTAIWISPVVENIPASDNTADGESYHGYWAQRIYEVNPNFGSAADLEALSEAIHARGMYLMVDIVTNHMGYDGCGTCVDYSVFDPFDNQSYFHPFCLINYNNATSIQVCWEGDNIVSLPDLRTEDSDVLGMWETWITQLVANYSIDGLRVDSMQQVDQAFWQPFMSAAGDLYAVGEVFNGDPTYTCPYQQYLPGVLNYPAYYWITQAFESTSGSIGNLVNGINEMKNDCLDTTLLGSFLENHDNPRFPSYTSDYSLDKNAIAFAMLQDGIPIVYEGQEQHYSGGSVPNNREDIWSSGYSTTSELYTFIKIINAIRTQALTKDSSYLTYKAYPVYSDSQTIAMRKGETYPIISVFTNSGASGSAYSITLSSSDTGFSENQSITELLTCTVSTTDSGGNLVVNISSGLPRVYYPTSAISGSTVCAESTSTLTISSPISTSTSDCTTASSVAVTFDETVTTTYGETIKLSGSISQLGDWNTQDAILLSAADYKSTDNVWFVTINLPAGIVFQYKYINVDSDGDVTWEADPNHTYTVSATCATAATIHDTWQN

SEQ ID NO: 126 - protein, 588 aa, Aspergillus bombycis
ATPADWRSQSIYFLLTDRFARTDGSTTATCNTEDRKYCGGTWQGIIDKLDYIQGMGFTAIWITPVTGQLPQDTAYGEAYHGYWQQDIYALNENHGTADDLKALSSALHERGMYLMVDVVANHMGYDGAGASVDYSVFNPFSSQDYFHSFCLIENYDDQTQSENCWLGDNSVSLPDLDTTKDEVKNEWYEWVGNLVSNYSIDGLRVDTVKHVQKDFWPGYNEAAGVYCIGEVLNGDPAYTCPYQDVMDGVLNYPIYYPLLNAFKSTSGSMNDLYNMINTVKSDCPDSTLLGTFVENHDNPRFASYTNDIALAKNVAAFIILNDGIPIIYAGQEQHYAGGNDPANREATWLSGYSTDSEIYKLIASANAIRNHAVSTDTGFVTYKNWPIYKDDTTIAMRKGTDGSQIVTILSNKGASGDAYTLSLGNTGYTAGQQLTEVIGCTTLTVGSDGNVPVPMAGGLPRVLYPTEKLGDSKICSSSGRGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 127 - protein, 570 aa, Alternaria sp.
ADTSAWKSRSIYFVLTDRIARSSSDTGGGSCSNLGNYCGGTFKGLESKLDYIKNLGFDAIWITPVVANSAGGYHGYWAQDLYAVNSNYGTAADLKSLVNTAHSKGIYVMVDVVANHMGQGAISGNRPEPLNQDSSYHSACDINYSSQTSIEQCRIANLPDLNTQSSQIRSLLNTWISWLVNEYSFDGVRIDTVKHVEKDFWPGFASAAGVYSIGEVWDGNPTYLAEYARLMPGLLNYATYYPMNNFYQQKGSSQALVDMMNTVRDTFPDPSALGTFLDNHDNNRWLNQKNDVTLLKNALAFVILSRGIPIVYYGTEQGYAGGADPANREDLWRSSFNTNADLYQAIKKLNAARTSAGGLAGNDHTHLYVSSNAYAWSRANGNLVVLTTNAGSGSNAQHCFNTQKANGRWTNVYGNGATVTADGSGNICVNVANGEPVVLLVSTATPTSATPTSNPSPTTLLTTSTACPTSVSVSFTHRVTTVFGDTIKITGNTAQLGNWNPSNGVALSAASYTSSNPIWTLTLPLPAGSAIQYKFVKVSSGGTVTWESDPNRSYSVPGCQASASVSSQWQ

SEQ ID NO: 128 - protein, 551 aa, Rhizopus microsporus
SPITIRSQNSNDWSSRVIYQLLTDRFAKTVDDQSPCSDLGNYCGGSFQGIINHLDYIAGMGFDAIWISPIPQNAQGGYHGYWATNFSAINSNFGSSNDLKKLVQAAHAKNMYVMLDVVANHVGTPSTPNNYNGYTFNQGSYYHSYCDINYNDQTSVEQCWLSGLPDLNTENDYVVNTLYSTVSNWISEYGFDGIRIDTVKHVRKDFWDGYVKAAGVFATGEVLHGSVSYVAPYQSHVPSLINYPLYYPIYDVFTKAATMTRLKSGYNDIQSGGFSNLNLLLNFIDNHDNPRLLSKADQSLVKNALTYSMLIQGIPVVYYGTEQSYKGGNDPNNREPLWTSGYSSSSEMYQFIKQVIQIRKGSNATVTMDIDQADNVYVFQRGNYLAVVNNYGQGSTNSVTVKSGSFADGTVLKDVFSGATATVKNKSITFQLQNGNPAVFSPQGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 129 - protein, 565 aa, Syncephalastrum racemosum
VPLSIIDKRAGVTTLSKRAAADDWKSRSIYQIVTDRFARSDGSTSGCGDLSNYCGGDYKGIQNQLDYIAGMGFDAIWISPIPENTDGGYHGYWAKNFEALNTNFGSADDLKALVTAAHGKGMYVMLDVVANHAGPTSGGDYSGFTFDSASNYHAQCDIDYENQTSIEQCWVADNLPDINTEDDTIVSKLHSIVSDWVTTYDFDGIRIDTVKHIRKDFWSGYEEAAGVFATGEVFDGDAAYVGPYQDQLSSLINYPLYYAIRDVFTAGSGFSRISDMLSSINSNFKDPSVLTTFVDNQDNARFLSVKSDTSLYKNALAFTILTEGIPVVYYGTEQGFKGGNDPNNREVLWTSNYDTSSDLYKFIKIVNDQVRQKSNKTVKLNVDVGTNTYAFTHGKNLIVVNNYGSGSTASVTVKVGDSIADGTKLVDAVSNITATVSGGSITFSLNNGLPALFVPSSGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 130 - protein, 583 aa, Rhizomucor pusillus
ATSDDWKGKAIYQLLTDRFGRADDSTSNCSNLSNYCGGTYEGITKHLDYISGMGFDAIWISPIPKNSDGGYHGYWATDFYQLNSNFGDESQLKALIQAAHERDMYVMLDVVANHAGPTSNGYSGYTFDDASLYHPKCTIDYNNQTSIEQCWVADELPDIDTENSDNVAILNDIVSGWVGNYSFDGIRIDTVKHIRKDFWTGYAEAAGVFATGEVFNGDPAYVGPYQKYLPSLINYPMYYALNDVFVSKSKGFSRISEMLGSNRNAFEDTSVLTTFVDNHDNPRFLNSQSDKALFKNALTYVLLGEGIPIVYYGSEQGFSGGADPANREVLWTTNYDTSSDLYQFIKTVNSVRMKSNKAVYMDIYVGDNAYAFKHGDALVVLNNYGSGSTNQVSFSVSGKFDSGASLMDIVSNITTTVSSDGTVTFNLKDGLPAIFTSATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 131 - protein, 553 aa, Dichotomocladium hesseltinei
QPVNITKRASAADWRSRAIYQVLTDRFARTDGSTSGCSNLSNYCGGTFKGITNKLDYIANLGFDAIWISPIPTNSPGGYHGYWATDFYGINSNFGSSNDLKELVNAAHAKGMYVMLDVVANHAGPTSNGDYSGYTFGSSGLYHNRCSINYNDQRSIEQCWVADDLPDINTENNDNVNKPNNIVSTWVKTYGFDAIRIDTVKHVRKDFWPGYTSAAGVFATGEVFDGNPSYVADYQNYMESLINYPLYYALNDVFASGYSFSRLSNQRVANYHAFKDVSVLPIFIDNHDNPRFLNKKNDIAQFKNALTYVLLGEGIPVVYYGSEQAYAGGADPANREALWSSGFSTNSDMYQFIAKLNRVRQKSNKSVYMDLDVQNNVYAFMHGKSLVVLNNFGNGASRQVTVNVGAQVASNTRLTDVVSGTSVTVSGSSVTFTINNGLPAVFTVSGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 132 - protein, 552 aa, Lichtheimia ramosa
RPFVKRATADDWRDRAIYQILTDRFARSDGSTDNCSDLSNYCGGNYQGIIQQLDYIEGMGFDAIWISPIPANADGGYHGYWATDFESLNDHFGSQDDLKALVDAAHERGMYVMLDVVANHAGPTNNGDYSGYTFGSSDLYHPQCSIDYSNQNSIEQCWVADNLPDIDTENDSNVNKLHDIVSTWVSTYGFDGIRIDTVKHVRKDFWPGYASAAGVFATGEVYDGDQTYVGAYQDYLDSLLNYPLYYALNDVFASGQGFQRLSNQRNAIMSAFKDVSVLTSFVDNHDVARFLSTKNDQALFKNALAFVLLGETIPVVYYGSEQGFAGGADPANREALWSSGYDTSSDLYQFIATINNNVRQKSGKKVYMDLDVQDNVYAFMHGDALVVLNNYGSGASNQVSVNVGAQVAESTSFTDAISGTSITVSSGSVTFTLDNGNPAIFVPAGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 133 - protein, 587 aa, Penicillium aethiopicum
ARTADWKPRSIYQTMTDRFARTDGSTTSPCNTKAGLYCGGTWRGTIDHLDYIQGMGFDAVMISPIIENIEGRVDYGEAYHGYWPLNLDNLNSHFGTHQDLLDLSDALHSRGMYFMMDTVINNMAYITNGSDPATDIDYSVFTPFNNADYFHPYCTMNWSVPAIAQRCNTGDDTVALPDLFTEHEDVQQLLIKWANKAIKTYSIDGLRIDAAKHVNPDFLRKFSDGVDIFMTGEVLEGSVSIMEDYQSNYINSLPNYPIYFEILSAFTNGNTSQLAIAVENMRVAIPDVNAMASFSENHDKPRIASYNDDMSIAKNVLVFTMLFDGIPMIYQGQEQHLKGDGVPHNREAIWLSKYDTEAELYKLIAKLNRIRNHAGYLGSDYFEDATHPIYQGSSELAFTKGVQGRQVVMVLSNQPSTSGRYALDLAVSYNAGTELMDVLNCNNYTVDNQGVLRVDMDKGEPRVFFPRKYMEGSGLCGYSGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 134 - protein, 597 aa, Subulispora sp.
LTPAEWGSQSIYQVLTDRFALTDGSTTASCDLNTYCGGTWLGIQNHLDYIQGMGFTAIWISPIVTNIAGDSVDGDSYHGYWAQDITTVNSAFGTEQDLINLSAALHERGMYLMVDVVNNHMGYLGCGTCVDYSEYTPFNEESYYHPYCPTDYSNLTSIQVCWEGDNIVSLPDLRTEDSDVRSMWYDWITPLVAKYSIDGLRMDSAEHVEKSFWPGWVSASGVYNVGEVDEGDPTIFPDWLNYIDGTLNYPAYYWITQAFQSTSGSISNLVTGVNQLKASMKTSTFGSFLENHDQPRFPSLTSDTDLAKNAIAFAMLADGVPIVYYGQEQGYSGGGVPNDREPLWTSGYSTTSAGYTFIKTINAVRHLAVTQDTAYVAYQAYPIYSDSRVIAMKKSSVLAVFSNIGSSGSGYSITLPAGAFAASQALTDAVSCQTYTADASGGLTFTFGQAPSVFYATASLAGSGLCGTTGTGGSTGTTTASETGGSSPTSTACASVPVTFNEKVTTVVGETIKISGSVAALGDWATGSAVALSAASYTSSNPQWDVTISFAPGTVIEYKYINVASSGAVTWEADPNHTYTVPASCATAAVVSDTWQT

SEQ ID NO: 135 - protein, 601 aa, Trichoderma paraviridescens
LTAAQWRSQSIYQVLTDRFSQTNGATNSACNAGNQVYCGGTWQGIIKNLDYIKSMGFTAIWISPVVENLAGNSADGEAYHGYWAQDIYQVNTNFGSAADLRALSEALHNAGMYLMVDIVTNHMGYLGCGTCVQYNTFNPFNSQSYYHPFCLINFNSSNMTQIQNCWEGDNTVSLPDLATENANVLSMWQTWITQLVANYTIDGLRMDSCFELNYGYFEPFQSSANVYIVGEVDNGDPAIVCPYQKNYGLNTLNYPAYYWITQAFQSTSGSISNLVNGLNTMKSECSDTTLLGSFMENHDNPRFPSLTSDISLAKNAIAFTMLADGIPIIYEGQEQHLNGGGVPNNREAIWLSGYSTSAVLYTHIKALNQIRSQAIKQNSAYVTTQAAVTYSDSSTIVTRKGSTGSQIVGVFSNKGANGNSYTLTLPSADTGFTSNEQVVEILSCTAYTTDSSGNLAVAMAGGLPRVFYARSSLSGSGICPNLGSGGGTPTSTPPTSCTAIPVTFDEKVTTTFGQTIKIAGDISALGNWNTANAVTLSAANYTSSNPLWAITLNLAPGQVVEYKYINVAQNGGVTWEADPNHTYTVPSACTAQPTVANTWQG

SEQ ID NO: 136 - protein, 598 aa, Byssoascus striatosporus
LSADDWRAQSIYQLLTDRFALTNGSTTAPCDTEEQIYCGGSWQGIIDKLDYIQGMGFTAIWISPVVENLSGDSADGEAYHGYWAQNVYEVNPNFGATSDLVALSQVVHDKGMYLMLDVVTNHMGYLGCGTCVDYSVFNPFNEESYYHPFCLIDYDNTTSIEVCWEGDNIVSLPDLRTEDSDVLSTWESWVTELVSNYTVDGIRLDSTEELDQAFLPPFESAAGVYIVGEVDNGDPAVVCPYQEYVSGVLNYPAYYWITQAFESTSGSIGNLVNGINTMKSDCSDTSLLGSFLENHDQPRFASLTSDISLAKNAIAFSMLQDGIPIVYAGEEQHYSGGAVPNDREALWLSGYPTSSTLYTWITSLNQIRSHAIATNSSYLTYNAYPVYSDDSTIVMRKGFADNQIVSVYTNQGADATAYTLDLPSTDTGFTASQSLVEIGGCTTTATDDSGNLAVAMASGLPRIYYPAAGLSGSGVCGQLGSGGGTPTSTPPTSCTAIPVTFDEKVTTTFGQTIKIAGDISALGNWNTANAVTLSAANYTSSNPLWAITLNLAPGQVVEYKYINVAQNGGVTWEADPNHTYTVPSACTAQPTVANTWQG

SEQ ID NO: 137 - protein, 615 aa, Aspergillus brasiliensis
LSAAEWRTQSIYFLLTDRFGRTDNSTTATCNTGDQIYCGGSWQGIINHLDYIQGMGFTAIWISPITEQLPQDTSDGEAYHGYWQQKIYDVNSNFGTADDLKSLSDALHARGMYLMIDVVPNHMGYAGSGNDVDYSVFDPFDSSSYFHPYCLITDWDNLTMVQDCWEGDTIVSLPDLNTTETVVRTIWYDWVADLVSNYSVDGLRIDSVLEVEPDFFPGYQEAAGVYCVGEVDNGNPALDCPYQDYLDGVLNYPIYWQLLYAFESSSGSISDLYNMIKSVASDCSDPTLLGNFIENHDNPRFAYYTSDYSQAKNVLSYIFLSDGIPIVYAGEEQHYSGGDVPYNREATWLSGYDTSAELYTWIATTNAIRKLAIAADSSYITYANDPIYTDSNTIAMRKGTSGSQVITVLSNKGSSGSSYTLTLSGSGYTSGTKLIEAYTCTSVTVDSNGDIPVPMASGLPRVLLPASVVDDSSLCGGSGSSTSTTTSTATATTTSKTSTTSSSSSSSSCTASATAIPITFEELVTTTYGEEIYLSGSISQLGDWDTSDAVKLSADDYTSSNPEWSVTVTLPVGTTFEYKFIKVESGGSVTWESDPNREYTVPECGSGETVVDTWR

SEQ ID NO: 138 - protein, 604 aa, Penicillium subspinulosum
ALSAEWRTQSIYFLLTDRFGRTDNSTTATCDTGDQIYCGGSWQGVINHLDYIQGMGFTAIWISPITEQLSGDTSDGEAYHGYWQQKIYNVNSNFGTADDLVALSDALHARDMYLMLDVVPNHMGYDGDGDDVDYSVFDPFDSSSYFHPYCLITDYDDIEMVQDCWEGDTIVSLPDLNTTETVVQDIWYAWVADLVANYSVDGLRIDSVLEVQPAFFPAYQSAAGVYCVGEVDNGDPTLDCPYQDYLDGILNYPIYYQLLYAFESSSGSISDLYDMINSVASDCSDPTLLGNFIENHDNPRFAYYTSDYSQAKNVASFIFLSDGIPIVYAGQEQHYSGGDVPYDREATWLSGYSTTAELYTWIATTNSIRKLAISLDDDYITYVNDPFYTDENTIAMRKGTSGLQVITVLSNLGADGSAYTLTLSGSGYDSGTDLIEVYTCTSVTVDSSGDIAVPMESGLPRVFLPESSIKDSDLCSGTTTTTTSTAATATATSTSTCTAATEVSIIFEELVTTTYGEEIYLSGSISELGSWDTSDALELSAANYTSSNPEWYLEVTLPVGTSFEYKFIMIESDGTVVWESDPNRSYTVPSACSGAVETVVDTWR

SEQ ID NO: 139 - protein, 606 aa, Penicillium antarcticum
LTPAEWRSQSIYFMLTDRFGRSDNSTTAACNVSDRTYCGGTWQGIINHLDYIQGMGFTAIWITPVTEQLPQDTGDGEAYHGYWQQNIYEVDSNLGTAADLLALSEALHARGMYLMVDVVANHMGYAGAGSSVEYSVFHPFSSSSYFHSYCLISNYDDQSNVEDCWLGDTIVSLPDVDTTQTAVQTLWYDWIGDLVSNYSIDGLRIDTVKHVQKSFWPGYNDAAGVYCVGEIFDGDPAYTCDYQNYMDGVLNYPIYYQLLYAFQSSSGSISDLYDMINSVKSDCADPTLLGNFIENHDNPRFASYTSDYSQAKNVISFLFLSDGIPIIYSGQEQHYSGGADPANREATWLSGYSTTAELYKYIATTNRIRKAAVSADSSYITTKNVPFYQDSHTLAMKKGSSASPVITVLSNYGSSGSSYTLSLSGSGYSSGTNLMEMYTCTSVTVDSSGNIAVPMASGLPRVLMLASSASSICASSTTTSTATVATQTTTLTTTGTSCTQATVLPVLFKELVTTTYGQNVYISGSISQLGSWDTSSAIALSASSYNSSNPLWQVAITLPVGTSFQYKFLEKTTGSTTIQWESDPNRSYTVPTGCVGTTATAIATWR

SEQ ID NO: 140 - protein, 609 aa, Penicillium coprophilum
LTPAEWRSQSIYFLLTDRFGRTDNSVTANCNVNDRVYCGGTWQGIINQLDYIQGMGFTAIWITPVTKQLSQNTGDGTSYHGYWQQDIYNVNPNHGTSDDLLALSKALHARGMYLMVDVVANHMGYAGAGNNVDYSVFTPFNSASYFHSYCLISNYNDQSNVENCWLGDTTVSLPDLDTTQSSVQTLWNNWISDLVSKYSIDGLRVDTVKHVQKSFWPAFNRAAGVYSVGEVFDGSPSYTCDYQKYMDGVLNYPMYYPLLRAFQSTSGSISDLYNMIGTLSSTCADSTLLGNFIENHDNPRFPSYTSDYSQAKNVLSFLFLSDGIPIVYSGQEQHYSGGSDPANREALWLSKYSTTAELYKYIATTNKIRKAAVAADSSYITSKNVAFYQDSHTLAMKKGSGSSPVITVLSNAGSSGSSYTLYLSGSGYSSGTQLMELYTCTSVTVDSSNKIAVPMASGLPRVFVLASSVSNSGLCGSSTPTTTATTATTATQTTTATTTAGGCTQATALPVLFKELVTTSYGQDIYISGSISQLGTWDTSKAVALSADSYTSSNPLWQATITLPVGTTFQYKFIKKANGAITWESDPNRSYTVPTGCSGSTATVTASWK

SEQ ID NO: 141 - protein, 602 aa, Penicillium olsonii
LTPAEWRSQSIYFLLTDRFGRDDNSTTATCNTGDRTYCGGTWQGIINQLDYIQGMGFTAIWITPVTEQLSANTGYGTAYHGYWQQDIYEVNPNHGSSADLKALSAALHARGMYLMVDVVANHMGYNGIGSSVDYSVFNPFSSSSYFHSYCLISNYNDQSNVENCWLGDTTVSLPDLDTTQTAVQTIWNEWITDLVSNYSIDGLRIDTVKHVQKSFWPGFNDAAGVYSVGEIFDGNPSYTCDYQNYLDGVLNYPIYYPLLYAFQSTSGSISDLYNMINTVASDCADSTLLGNFIENHDNPRFPSYTGDYSQAKNVISYLFLSDGIPIIYSGQEQHYSGASDPANREALWLSGYSTTAELYKWIATTNKIRKLAVSADSSYITSKNSPFYQDSHTLGMKKGSVITILSNNGASGSSYTLSLSGSGYSSGTKLMELYTCTSITVDSSGNIPVPMVSGLPRALIPASSIGSNGLCGSTTSPTTTAATQTTTATTTGTCTQATALPVLFKELVTTSYGQNVYISGSISQLGNWDASSAIALSASSYTSSNPLWQVTITLPVGTKFEYKFIEKSSGSATATWESDPNRSYTVPTGCAGTTATVTATWR

SEQ ID NO: 142 - protein, 621 aa, Penicillium vasconiae
LTAAEWRTQSIYFLLTDRFGRTDNSTTATCSVSDRIYCGGSWQGIINHLDYIQGMGFTAIWITPVTEQLSQDTGDGEAYHGYWQQEIYNVNTNYGTAADLLALSKALHSRGMYLMVDVVANHMGYDGAGNTVDYSVFNPFDSSSYFHSYCEISDYSNQTNVEDCWLGDTTVSLPDLDTTLSSVQTIWYNWVTELVSNYSIDGLRIDTVKHVQKSFWPGYNSAAGVYCVGEVFDGDPAYTCPYQSYLDGVLNYPIYYQLLYAFESTSGSISSLYNMINSVASDCSDPTLLGNFIENHDNPRFASYTSDYSQAKNVISFIFFSDGIPIVYAGQEQHYSGGSDPANREATWLSGYDTTATLYKYITSTNKIRSLAISKDTAYITSKNNAFYTDSNTIAMKKGSSGSQVITVLSNRGSSGSSYTLTLSGSGYSSGTQLMEMYTCTAVTVDSSGNIAVPMASGLPRIYMLASSACSICSSSCSTTTTTSTTSTSTTTASTLKTTTSTTSATSTTSTSCTQATALPVLFKEIVTTSYGQNIYISGSISQLGSWDTSNAVALSADQYTSSNNLWYVVVTIPVGTSFEYKFIEETSGSSTITWESDPNRSYTVPTGCAGSTATVTATWR

SEQ ID NO: 143 - protein, 615 aa, Penicillium sp.
LTAAEWRSQSIYFLLTDRFGRTDNSTTATCNVSDRIYCGGSWQGIINHLDYIQGMGFTAIWITPVTEQLSQDTGDGEAYHGYWQQEIYNVNTNYGTAADLLALSKALHSRGMYLMVDVVANHMGYDGAGNTVDYSVFNPFDSSSYFHSYCEITDYSNQTNVEDCWLGDTTVSLPDLNTTLSSVQTIWYDWVAALVSNYSIDGLRIDTVKHVQESFWPEYNSAAGVYCVGEVFDGDPAYTCPYQNYLDGVLNYPIYYQLLYAFESTSGSISDLYNMINSVASDCSDPTLLGNFIENHDNPRFASYTSDYSQAKNVLSFIFFSDGIPIVYAGQEQHYSGGSDPANREATWLSGYDTSAELYTWITSTNKIRSLAVSKDTAYITSKNDAFYTDSNTIAMKKGSGGSQVVTVLSNRGSSGSSYTLTLSGSGYSSGTKLMEMYTCTAVTVDSSGNIAVPMASGLPRVYMLASSACSICSSACSTTTTSSTTSTATTTSTTLKTTTTTTSTSCTQATALPVLFKEIVTTSYGQNIYISGSISELGDWDTSNAVALSADQYTSSNNLWYVVVTIPVGTSFEYKFIEETSGSSSITWESDPNRSYTVPTGCAGSTATVTATWR

SEQ ID NO: 144 - protein, 606 aa, Heterocephalum aurantiacum
LTAAEWRQQSIYFLLTDRFARTDGSTTAACNLSQRAYCGGSWQGIINHLDYIQGMGFTAIWITPVTKQIEASTSDGTAYHGYWQQDIYNINSHYGTADDLRALSSALHSRGMYLMIDVVANHMGYPGAGTSVDYSIFTPFGSSSYFHSYCQITDYDNQSNVENCWLGDNVVSLPDLNTQNSNVRNLWYDWVEELVANYSVDGLRVDTVKHVEKDFWPSYNAAAGVYCVGEVFHGDPAYTCPYQNYMDGVLNYPIYYQLLYAFQSSSGSITDLYNMINSVASDCKDPTTLGNFIENHDNPRFPSYTSDMSQAKSVIAFLFLSDGIPIIYAGQEQHYSGGADPNNREAIWLSGYSTSSTLYQFISSTNSIRKLAISKDSSYLTSRNNPFYTDSNTIAMRKGSSGSQVITVLSNKGSSGNSYTLTLTNHGYSSGAQLTELYTCSSIQVASSGGLAVPMASGLPRVLVPSSWIQGSGLCGGGSTTTTTTATTTTTTTTSTSSCAAATSLAVVFNELVTTYYGENIFIAGSISQLGSWDTGKSVALSASQYTSSNPLWTATVSLPVGTSFQYKFIKKEPDGQVVWESDPNRSYTVPAGCAGTTQTVNTSWR

SEQ ID NO: 145 - protein, 602 aa, Neosartorya massa
LTPAEWRSQSIYFLLTDRFGREDNSTTAACDVTQRLYCGGSWQGIINHLDYIQGMGFTAIWITPVTEQFYEDTGDGTSYHGYWQQNIYEVNYNYGTAQDLKNLADALHARGMYLMVDVVANHMGYDGAGNTVDYSVFTPFDSSSYFHPYCLISDYSNQTNVEDCWLGDTTVSLPDLDTTDTTVRTIWYDWVKGLVANYSIDGLRIDTVKHVEKDFWPGYNDAAGVYCVGEVFSGDPTYTCPYQNYLDGVLNYPIYYQLLYAFESTSGSISNLYDMINSVASDCADPTLLGNFIENHDNPRFASYTSDYSQAKNVISFIFFSDGIPIVYAGQEQHYSGGADPANREAVWLSGYSTSATLYSWIASTNRIRKLAISKDAAYITSKNNPFYYDSNTLAMRKGSIAGAQVITVLSNKGSSGSSYTLSLSGTGYSAGASLVEMYTCTTLTVDSSGNLPVPMASGLPRVLVPSSWVSGSGLCGSGSTTTTTTTATATTTACTSATALPIVFEEVVTTTYGENVYLTGSISQLGNWDTSSAIALSASKYTSSNPEWYVTVTLPVGTSFQYKFFKKESDGSIVWESDPNRSYTVPTGCAGTTVTVSDTWR

SEQ ID NO: 146 - protein, 588 aa, Penicillium janthinellum
ATPAQWRSQSIYFMLTDRFARTDGSTTAPCDTSQRAYCGGTWQGIIDKLDYIQGMGFTAIWITPVTGQLDGDTGDGTAYHGYWQQDIYSLNSNYGTASDLKALASALHARGMYLMVDVVANHMGYNGAGNTVDYSVFDAFNSNQYFHSYCEVTNYSNQTNVEDCWLGDTTVSLPDLNTELSSVQSIWYNWVGSLVSNYSIDGLRVDTVKHVQKDFWPGYNKAAGVYCVGEVFDGDASYTCPYQEVMDGVLNYPMYYPLLRAFQSTSGSMSDLYNMINTVKSTCSDSTLLGTFVENHDNPRFASYTNDMSLAKNVAAFTIMADGIPIIYAGQEQHYSGGSDPANREAVWLSGYNTDSALYKLIAKVNAIRSYAISQSASYVTYKNYPIYQDASTLAMRKGSSGTQTITVLSNRGASGSQYTLSLGNTGYSTGTTLTEIITCAKITVDSSGNVPVPMASGEPRILYPSSSIKGSAICASSGRGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 147 - protein, 589 aa, Aspergillus brasiliensis
ATPAEWRSQSIYFLLTDRFARTDNSTTASCDLSARQYCGGSWQGIINQLDYIQGMGFTAIWVTPVTAQIPQDTGYGQAYHGYWQQDAYALNSHYGTADDLKALATALHSRGMYLMVDVVANHMGHNGTGSSVEYSVYNPFNAKKYFHNLCWISNYDNQTNVEDCWLGDNTVALPDLDTTRTDVKNMWYDWVKSLVSNYSVDGLRVDTVKNVQKNFWPGYNNASGVYCIGEVFDGDASYTCPYQDDLDGVLNYPMYYPLLRAFKSTTGSISDLYNMINTVKSTCKDSTLLGTFIENHDNPRFANYTSDMSLAKNVATFTILADGIPIIYAGQEQHYSGGNDPYNREATWLSGYKTTSELYTHIAASNKIRTHAIKQDSGYLTYKNYPIYQDTSTLAMRKGYNGTQTITVLSNLGASGSSYTLSLPGTGYTAGQKITEIYTCTNLTVNSNGSVPVPMKSGLPRILYPTDKLVNGSSFCSSSGRGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 148 - protein, 588 aa, Aspergillus westerdijkiae
ATPAQWRSQSIYFLLTDRFARDDGSTTATCNTEDRKYCGGTWQGIIDQLDYIQGMGFTAIWITPVTAQLTEDTKYGDAYHGYWQQDIYSLNENYGTADDLKALADALHERDMYLMVDVVANHMGYAGAGDSVDYSVFNPFNSQDYFHSFCLIQDYNDQTQSEDCWLGDNSVSLPDLDTTKSEVQDIWYDWVGGLVSNYSIDGLRIDTVKHVQKEFWPGYNDAAGVYCIGEILDGDASYTCPYQEVLDGVLNYPIYYPLLNAFKSTSGSISDLYNMINTVKSDCPDSTLMGTFIENHDNPRFASYTDDIALAKNVAAFTILADGIPIVYAGQEQHYAGGEDPANREATWLGKYNTDSELYKLIAASNAIRNHAISTDKEYVNYKNYPIYKDDSTIAMRKGFDGAQIITVLSNQGSSGSSYTLSLGDTGFSSGDKLTEIYTCTAVTVDSDGKVPVPMDGGAPRALFPTEKLSGSSLCSGSGRGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 149 - protein, 476 aa, Hamigera avellanea
ATPADWRSRSIYFILTDRFARTDGSTTAECDTSARAYCGGTWRGIINKLDYIQNMGFTAIWITPVTAQLPGSTGHGSAYHGYWQQDIYSLEPNYGTADDLRALASALHERNMYLMVDVVANHMGWAGSGDSVDYSVFNPFDSADYFHPYCLISNYEDQTEVENCWLGDTNVALVDLDTTRSDVQNIWYEWVDSLVGNYSIDGLRIDTVRHVQKDFWPGFNDAAGVYSVGEVFSGDTAYTCPYQEVLDGVLNYPIYYPLLRAFQSTSGSINDLYNMINTVKSDCADSTLMGTFLENHDNPRFASYTSDVALAKNAIAFTILSDGIPIIYAGQEQHYSGGNDPANREAVWLSGYSTDSELYSFVAVTNQIRNYAISQDQGYVTWKNVPIYQDTSTLAMRKGTDGSQVITVLSNLGASGSSYTLTLGGSGYSSGQQLTEIFSCATVTVDSSGNIPVPMGSGQPKVFYPTAGLGGSGICQ

SEQ ID NO: 150 - protein, 586 aa, Hamigera avellanea
ATPADWRSRSIYFILTDRFARTDGSTTAECDTSARAYCGGTWRGIINKLDYIQNMGFTAIWITPVTAQLPGSTGHGSAYHGYWQQDIYSLEPNYGTADDLRALASALHERNMYLMVDVVANHMGWAGSGDSVDYSVFNPFDSADYFHPYCLISNYEDQTEVENCWLGDTNVALVDLDTTRSDVQNIWYEWVDSLVGNYSIDGLRIDTVRHVQKDFWPGFNDAAGVYSVGEVFSGDTAYTCPYQEVLDGVLNYPIYYPLLRAFQSTSGSINDLYNMINTVKSDCADSTLMGTFLENHDNPRFASYTSDVALAKNAIAFTILSDGIPIIYAGQEQHYSGGNDPANREAVWLSGYSTDSELYSFVAVTNQIRNYAISQDQGYVTWKNVPIYQDTSTLAMRKGTDGSQVITVLSNLGASGSSYTLTLGGSGYSSGQQLTEIFSCATVTVDSSGNIPVPMGSGQPKVFYPTAGLGGSGICQSSGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 151 - protein, 576 aa, Meripilus giganteus
RPTVFDAGADAHSLHARAPSGSKDVIIQMFEWNWDSVAAECTNFIGPAGYGFVQVSPPQETIQGAQWWTDYQPVSYTLTGKRGDRSQFANMITTCHAAGVGVIVDTIWNHMAGVDSGTGTAGSSFTHYNYPGIYQNQDFHHCGLEPGDDIVNYDNAVEVQTCELVNLADLATDTEYVRGRLAQYGNDLLSLGADGLRLDASKHIPVGDIANILSRLSRSVYITQEVIFGAGEPITPNQYTGNGDVQEFRYTSALKDAFLSSGISNLQDFENRGWVPGSGANVFVVNHDTERNGASLNNNSPSNTYVTATIFSLAHPYGTPTILSSYDGFTNTDAGAPNNNVGTCSTSGGANGWLCQHRWTAIAGMVGFRNNVGSAALNNWQAPQSQQIAFGRGALGFVAINNADSAWSTTFTTSLPDGSYCDVISGKASGSSCTGSSFTVSGGKLTATVPARSAIAVHTGQKGSGGATPTSAPSTTPTSGTVSMTFAEQATTTFGENIFLVGSISQLGNWNPASAIALSSAAYPTWSVSVNIPAGTTFQYKFIRKETDGSVVWESDPNRQATAPASGTTTLTSSWR

SEQ ID NO: 152 - protein, 575 aa, Cerrena unicolor
RPLNASNALDARAPSGAKSVIIQMFEWTWDSVAAECTNFIGPAGYGFVQVSPPQETIQGDQWWTDYQPVSYILTSKRGTRDQFAAMIDTCHDAGVKVIVDTIWNHMAGVESGTGVAGSSFTHYNYPGIYQNQDFHHCGLESGDDIVNYDNAQEVQTCELVNLADLATETDYVRGRLAEYGNDLLSLGADGLRLDAAKHIAVGDLANIIGRLNSTPYITQEVIFGSGEPITPNQYTGNGDVQKFRYTSALKDAFLNGDISSLQDFENRGWVAGSGANVFVTNHDTERNGNSLNNNSPNNAYTLAMIFSLAHPYGTPSILSSYSGFTDTDAGAPNGGAGTCSGSGGSNGWLCQHRWTAVAGMVGFRNTVGSAALNNWVSPQSSQIAFGRGALGFVAINNGDSTWSTTFTTSLPDGTYCDVITGTSSSGSCTGSSFTVSGGTFTANVAARDAVAIHTGATGTGSGSGNTSTGSGGTTSDTVSVSFAETATTTFGENIFLVGSISQLGAWDPASAIALSSASYPTWTVTVTLPAGTTFEYKFIRKETDGSVVWESDPNRQATTPSSSDAATTTLSTSWR

SEQ ID NO: 153 - protein, 562 aa, Physalacria cryptomeriae
APFLELQVRAPSSTKQVIIQMFEWTWDSVAAECTDFIGPAGYGYVQVSPPAEHITGDQWWTDYQPVSYILTSKRGNRSQFANMVTTCHTAGVLVIADALFNHMAGIESGTGTAGSSFTHYDYPGIYQTQDFHHCGLTSGDDISDYSSQAQVQTCELVNLADLATDTEYVRAKLASYANDLISLGVNGLRLDAAKHIATDDIKNILSRLSSTVYITQEVIFGSGEPVTPSMYTQNGDVQEFRYTSTLQSAFSGGDISQLQNLDSKGWIAGTSANVFVANHDTERGGSSLNYKSSSNTYVTATIFSLAHPYGTPTILSSYEFSDTDAGSPNGGAGTCSTTGGANGWLCQHRWVAFSGMVGFHNNVGTASLTNWVSPQSNQIAFERSGKGFVAINNADSAWTATFTTSLAAGSYCDVITGTSNGSACSGTSYTVSGGSFSATVAARSAVAIHTGATGSGSGGGGGSTGSVAITFQETATTTLGENIFLVGSISQLRTWAPASAIALSSASYPTWSVTVSIPAGTTFEYKFIRKESDGSVVWESDPNRSATASSSASTQTILTSWR

SEQ ID NO: 154 - protein, 578 aa, Lenzites betulinus
RPASTVFHGAETRSLDARAPSGSKDVIIQMFEWTWDSVAAECTNFIGPAGYGFVQGSPPQEHIQGAQWWTDYQPVSYTLTSKRGDRTSFANMIQTCHTAGVGVIVDTLFNHMAGVDSGTGVAGSSFTHYNYPGIYQNQDFHHCGLEPGDDIVNYDNAVEVQTCELDNLADLATETEYVRGRLAQYGNDLLSLGADGMRLDAAKHIAVGDIANILSRLNRTVYITQEVIFGAGEPITPNQYTGNGDVQEFRYTSALQDAFLNSGIANLQVLENRGWVPGSGANVFVTNHDTERNGASLNNNSPSNTYVTAMIFSLAHPFGTPSILSSYSGFTDTDAGAPNGGVGTCSGSGGTNGWLCQHRWTAVAGMVGFRNQVGSAALGNWQSPQSQQIAFGRGALGFVAINNADSAWSATFTTSLPDGSYCDVISGQTSGSTCTGSSFTVSGGSLSATVPARSAIAVHTGQKGTGSGSGTGTGGGGSTGSGNVAVNFAETATTTFGENIFVVGSISQLGTWNTANAIALSSPSYPTWTVSISIPAGTTFQYKFIRKETDGSVVWESDPNRQATAPASGSTTLSTSWR

SEQ ID NO: 155 - protein, 571 aa, Trametes ljubarskyi
RPATFDAADARSVQPRAPSGSKDVIIQMFEWTWDSVAAECTNFIGPAGYGFVQGNPPQEHIQGDQWWTDYQPVSYILTSKRGDRTAFANMISTCHAAGVGVIVDTIFNHMSGVDSGTGVAGSSFTHYNYPGIYQNQDFHHCGLEPGDDIVNYDNAVEVQTCELENLADLATDTEYVRGRLAQYANDLLSLGADGLRLDAAKHIPTGDIANILSRLNRSVYITQEVIYGDGEPITPNQYTGNGDVQEFRYTTALKNAFLGGGISSLQSFDNLGWVPGTGANVFVTNHDTERNGNSLNNNSPSNTYVTAMIFSLAHPYGTPTILSSYSGFTNTDAGAPNGGTGTCSGSGGANGWLCQHRWTAVAGMVGFRNNVGSAALTNWQSPQSQQIAFGRGALGFVAINNADSAWSTTFTTSLPDGSYCDVVSGTSSNGGCTGSSFSVSGGSLTATVPARSAIAIHTGETGSGSNSGGGSGGSGTVTINFAETATTTFGENIFVVGSIPQLGSWNPANAIALSSASYPTWTVSVSVPAGTTFEYKFIRKETDGSVVWESDPNRSDTAPASGTQTITTSWR

SEQ ID NO: 156 - protein, 451 aa, Bacillus subtilis
GPAAASAETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTFDYAAISNEVKSIPNWTHGNTQIKNWSDRWDVTQNSLLGLYDWNTQNTQVQSYLKRFLERALNDGADGFRFDAAKHIELPDDGSYGSQFWPNITNTSAEFQYGEILQDSASRDAAYANYMDVTASNYGHSIRSALKNRNLGVSNISHYAYDVSADKLVTWVESHDTYANDDEESTWMSDDDIRLGWAVIASRSGSTPLFFSRPEGGGNGVRFPGKSQIGDRGSALFEDQSITAVNRFHNVMAGQPEELSNPNGNNQIFMNQRGSHGVVLANAGSSSVSINTPTKLPDGRYDNKAGAGSFQVNDGKLTGTINARSVAVLYPDDIEIRCNTFFQ

SEQ ID NO: 157 - protein, 633 aa, Bacillus subtilis
GPAAASAETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITLRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 158 - protein, 487 aa, Schwanniomyces occidentalis; identical to SEQ ID NO: 79

SEQ ID NO: 159 - protein, 583 aa, Rhizomucor pusillus
ATSDDWKGKAIYQLLTDRFGRADDSTSNCSNLSNYCGGTYEGITKHLDYISGMGFDAIWISPIPKNSDGGYHGYWATDFYQLNSNFGDESQLKALIQAAHERDMYVMLDVVANHAGPTSNGYSGYTFGDASLYHPKCTIDYNDQTSIEQCWVADELPDIDTENSDNVAILNDIVSGWVGNYSFDGIRIDTVKHIRKDFWTGYAEAAGVFATGEVFNGDPAYVGPYQKYLPSLINYPMYYALNDVFVSKSKGFSRISEMLGSNRNAFEDTSVLTTFVDNHDNPRFLNSQSDKALFKNALTYVLLGEGIPIVYYGSEQGFSGGADPANREVLWTTNYDTSSDLYQFIKTVNSVRMKSNKAVYMDIYVGDNAYAFKHGDALVVLNNYGSGSTNQVSFSVSGKFDSGASLMDIVSNITTTVSSDGTVTFNLKDGLPAIFTSATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 160 - protein, 616 aa, Aspergillus niger
AEWRTQSIYFLLTDRFGRTDNSTTATCDTGDQIYCGGSWQGIINHLDYIQGMGFTAIWISPITEQLPQDTADGEAYHGYWQQKIYDVNSNFGTADDLKSLSDALHARGMYLMVDVVPNHMGYAGNGNDVDYSVFDPFDSSSYFHPYCLITDWDNLTMVQDCWEGDTIVSLPDLNTTETAVRTIWYDWVADLVSNYSVDGLRIDSVLEVEPDFFPGYQEAAGVYCVGEVDNGNPALDCPYQKVLDGVLNYPIYWQLLYAFESSSGSISNLYNMIKSVASDCSDPTLLGNFIENHDNPRFASYTSDYSQAKNVLSYIFLSDGIPIVYAGEEQHYSGGKVPYNREATWLSGYDTSAELYTWIATTNAIRKLAISADSAYITYANDAFYTDSNTIAMRKGTSGSQVITVLSNKGSSGSSYTLTLSGSGYTSGTKLIEAYTCTSVTVDSSGDIPVPMASGLPRVLLPASVVDSSSLCGGSGRTTTTTTAATSTSKATTSSSSSSAAATTSSSCTATSTTLPITFEELVTTTYGEEVYLSGSISQLGEWDTSDAVKLSADDYTSSNPEWSVTVSLPVGTTFEYKFIKVDEGGSVTWESDPNREYTVPECGNGSGETVVDTWR

SEQ ID NO: 161 - protein, 512 aa, Bacillus stearothermophilus
APFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGKAWDWEVDTEFGNYDYLMYADLDMDHPEVVTELKNWGKWYVNTTNIDGFRLDAVKHIKFSFFPDWLSYVRSQTGKPLFTVGEYWSYDINKLHNYITKTDGTMSLFDAPLHNKFYTASKSGGAFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGGTEKPGSGLAALITDGPGGSKWMYVGKQHAGKVFYDLTGNRSDTVTINSDGWGEFKVNGGSVSVWVPRKTTVSTIARPITTRPWTGEFVRWTEPRLVAWP

SEQ ID NO: 162 - protein, 483 aa, Bacillus halmapalus
HHNGTNGTMMQYFEWHLPNDGNHWNRLRDDASNLRNRGITAIWIPPAWKGTSQNDVGYGAYDLYDLGEFNQKGTVRTKYGTRSQLESAIHALKNNGVQVYGDVVMNHKGGADATENVLAVEVNPNNRNQEISGDYTIEAWTKFDFPGRGNTYSDFKWRWYHFDGVDWDQSRQFQNRIYKFRGKAWDWEVDSENGNYDYLMYADVDMDHPEVVNELRRWGEWYTNTLNLDGFRIDAVKHIKYSFTRDWLTHVRNATGKEMFAVAEFWKNDLGALENYLNKTNWNHSVFDVPLHYNLYNASNSGGNYDMAKLLNGTVVQKHPMHAVTFVDNHDSQPGESLESFVQEWFKPLAYALILTREQGYPSVFYGDYYGIPTHSVPAMKAKIDPILEARQNFAYGTQHDYFDHHNIIGWTREGNTTHPNSGLATIMSDGPGGEKWMYVGQNKAGQVWHDITGNKPGTVTINADGWANFSVNGGSVSIWVKR

SEQ ID NO: 163 - protein, 478 aa, Aspergillus oryzae
ATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 164 - protein, 483 aa, Bacillus amyloliquefaciens
VNGTLMQYFEWYTPNDGQHWKRLQNDAEHLSDIGITAVWIPPAYKGLSQSDNGYGPYDLYDLGEFQQKGTVRTKYGTKSELQDAIGSLHSRNVQVYGDVVLNHKAGADATEDVTAVEVNPANRNQETSEEYQIKAWTDFRFPGRGNTYSDFKWHWYHFDGADWDESRKISRIFKFRGEGKAWDWEVSSENGNYDYLMYADVDYDHPDVVAETKKWGIWYANELSLDGFRIDAAKHIKFSFLRDWVQAVRQATGKEMFTVAEYWQNNAGKLENYLNKTSFNQSVFDVPLHFNLQAASSQGGGYDMRRLLDGTVVSRHPEKAVTFVENHDTQPGQSLESTVQTWFKPLAYAFILTRESGYPQVFYGDMYGTKGTSPKEIPSLKDNIEPILKARKEYAYGPQHDYIDHPDVIGWTREGDSSAAKSGLAALITDGPGGSKRMYAGLKNAGETWYDITGNRSDTVKIGSDGWGEFHVNDGSVSIYVQK

SEQ ID NO: 165 - protein, 583 aa, Rhizomucor pusillus; identical to SEQ ID NO: 130

SEQ ID NO: 166 - protein, 623 aa, Kionochaeta ivoriensis
LSPAGWRQQSIYQVMTDRFARTDGSTIASCDTSQQAYCGGTWQGLINKLDYIQGMGFTAVWISPMVHQMAGATSDGESYHGYWAQDINTVNSAFGTAADLKALSAALHARGMYLMLDVVTNHFAYDGCGTCVDYSIFNPFNSESYFHPFCLIDYSNTTSIQVCWEGDNTVSLPDLRTEDSDVRSIWNSWISSVISTYGVDGLRVDSAQQVETSFWAGFEAAAGVYMVGEVFNGDPTYVTPFQDYMDGVLNYPAYYWITQAFESTSGSISNLANGMNTMKSLAKNTSLLGSFLENHDNPRFPSLTSDMSLAQNAIAFTMLMDGIPIIYQGQEQHFSGGGVPSDREAVWLSGYPNDTTLYAWITKLNAVRSWAIAKDSSYLAYMAYPVYTDTHTIAMRKGDTGYQVISVYTNVGASGSSYSVTLTSADTGFTASQSVVDLVGCKTYTADSTGSLSLSLTGGIPIILYPAASLTGNTICTSTGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 167 - protein, 588 aa, Aspergillus niger
LSAAEWRTQSIYFLLTDRFGRTDNSTTATCDTGDQIYCGGSWQGIINHLDYIQGMGFTAIWISPITEQLPQDTADGEAYHGYWQQKIYDVNSNFGTADDLKSLSDALHARGMYLMVDVVPNHMGYAGNGNDVDYSVFDPFDSSSYFHPYCLITDWDNLTMVQDCWEGDTIVSLPDLNTTETAVRTIWYDWVADLVSNYSVDGLRIDSVLEVEPDFFPGYQEAAGVYCVGEVDNGNPALDCPYQKVLDGVLNYPIYWQLLYAFESSSGSISNLYNMIKSVASDCSDPTLLGNFIENHDNPRFASYTSDYSQAKNVLSYIFLSDGIPIVYAGEEQHYSGGKVPYNREATWLSGYDTSAELYTWIATTNAIRKLAISADSAYITYANDAFYTDSNTIAMRKGTSGSQVITVLSNKGSSGSSYTLTLSGSGYTSGTKLIEAYTCTSVTVDSSGDIPVPMASGLPRVLLPASVVDSSSLCGGSGRGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 168 - protein, 588 aa, Aspergillus oryzae
ATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGPGSSVDYSVFVPFNSASYFHPFCFIQNWDNQTQVEDCWLGDNTVSLPDLDTTKDVVKNEWYDWVGSLVSNYSIDGLRIDTVKHVQKDFWPGYNKAAGVYCIGEVLDGDPAYTCPYQEVLDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVDSSGDVPVPMAGGLPRVLYPTEKLAGSKICSSSGRGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 169 - protein, 583 aa, Penicillium canescens
LTPAEWRSQSIYFMLTDRFGRSDNSTTAACNVSDRTYCGGTWQGIINHLDYIQGMGFTAIWITPVTEQLPQDTGDGEAYHGYWQQNIYEIDSKLGTAADLLALSKALHARGMYLMVDVVANHMGYAGSGNSVDYSVFNPFSSSSYFHSYCLISNYDDQSNVENCWLGDTIVSLPDLDTTQTAVQTIWYDWIADLVSNYSIDGLRIDTVKHVQKSFWPGYNDAAGVYCVGEIFDGDPAYTCDYQNYMDGVLNYPIYYQLLYAFQSSSGSISDLYNMINSVKSDCADSTLLGNFIENHDNPRFASYTSDYSQAKNVISFLFLSDGIPIIYSGQEQHYSGGADPANREATWLSGYSTTAELYKYIATTNKIRKLAVSDSSYLTTKNVPFYQDSHTLAMKKGSSASPVITVLSNYGSSGSSYTLSLSGSGYSSGTKLMEMYTCTSVTVDSSGNIAVPMASGLPRVLMLASSANSLCGSSGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 170 - protein, 583 aa, Acidomyces acidothermus
LTPAQWRGQSIYQVLTDRFGRTDDSTTAACDVNDYCGGSWQGIINHLDYIQDMGFSAIWISPVVENLVGDTQDGSAYHGYWAQNIYALNPNFGTVSDLVALSAALHQRGMYLMVDVVTNHMGYDGCGDCVDYSVFTPFNSQSYFHPFCLIDYNNSTSIKVCWEGDNIVSLPDMRTEDSDVATEWNTWISELVSNYSIDGLRIDSAQQVDNAFFPPFQAAAGGIHVLGEVFNGDPNYVCPYQDFMSGVLNYPAYYYITQAFQSTSGSISNLVNGINQMKSTCTDTTLLGSFLENHDNPRFPSYTSDLSLDKNAITFTILQDGIPIIYEGQEQHYSGGTVPNNREAIWLSGYDKSAPLYTWIASVNQIRNQAIFKDSNYLTYMAWPIYSDASTIAMRKGFDGLQIISVYSNKGASAASYTISLESSTTGFTANEALVEVMSCTTYTTDGSGNLAVTISGGLPAVFYPKAQLAGSGICGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 171 - protein, 586 aa, Kinochaeta ivoriensis
LSPAGWRQQSIYQVMTDRFARTDGSTIASCDTSQQAYCGGTWQGLINKLDYIQGMGFTAVWISPMVHQMAGATSDGESYHGYWAQDINTVNSAFGTAADLKALSAALHARGMYLMLDVVTNHFAYDGCGTCVDYSIFNPFNSESYFHPFCLIDYSNTTSIQVCWEGDNTVSLPDLRTEDSDVRSIWNSWISSVISTYGVDGLRVDSAQQVETSFWAGFEAAAGVYMVGEVFNGDPTYVTPFQDYMDGVLNYPAYYWITQAFESTSGSISNLANGMNTMKSLAKNTSLLGSFLENHDNPRFPSLTSDMSLAQNAIAFTMLMDGIPIIYQGQEQHFSGGGVPSDREAVWLSGYPNDTTLYAWITKLNAVRSWAIAKDSSYLAYMAYPVYTDTHTIAMRKGDTGYQVISVYTNVGASGSSYSVTLTSADTGFTASQSVVDLVGCKTYTADSTGSLSLSLTGGIPIILYPAASLTGNTICTSGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 172 - protein, 585 aa, Aspergillus terreus
LTPAEWRSQSIYFLLTDRFGRTDNSTTAACDTSDRVYCGGSWQGIINQLDYIQGMGFTAIWITPVTGQFYENTGDGTSYHGYWQQDIYDLNYNYGTAQDLKNLANALHERGMYLMVDVVANHMGYDGAGNTVDYSVFNPFSSSSYFHPYCLISNYDNQTNVEDCWLGDTTVSLPDLDTTSTAVRNIWYDWVADLVANYSIDGLRVDTVKHVEKDFWPGYNSAAGVYCVGEVYSGDPAYTCPYQNYMDGVLNYPIYYQLLYAFESSSGSISDLYNMISSVASSCKDPTLLGNFIENHDNPRFASYTSDYSQAKNVITFIFLSDGIPIVYAGQEQHYSGGSDPANREATWLSGYSTSATLYTWIATTNQIRSLAISKDAGYVQAKNNPFYSDSNTIAMRKGTTAGAQVITVLSNKGASGSSYTLSLSGTGYSAGVTLVETYTCTTVTVDSSGNLPVPMTSGLPRVFVPSSWVNGSALCNGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 173 - protein, 565 aa, Thamnidium elegans
VPLSVLDKRNGVTTLSKRAAAADWKSRSIYQLVTDRFGRSDGSTSACGDLSNYCGGDYKGIQNQLDYIAGMGFDAIWISPIPENTDGGYHGYWAKDFEKLNTNFGSADDLKALVTAAHGKGMYVMLDVVANHAGPASGGDYSGFTFSSASNYHPQCTIDYDNQTSVEQCWVADDLPDINTEDDTIVSKLHSIVSDWVTTYDFDGIRIDTVKHIRKDFWSGYEEAAGVFATGEVFDGDAAYVGPYQDQLSSLINYPLYYAIRDVFSAGSGFSRISDMLSTIKSNFKDPSVLTTFVDNQDNARFLSVKSDMSLYKNALAFTILTEGIPVVYYGTEQGFKGGDDPKNREVLWTSNYDTSSDLYKFIKIVNNDVRQKSDKTVTLDVDVGTNTYAFTHGKNLIVVNNYGSGSTESVTVKVGDSVADGTKLVDAVSNITATVSGGSITFSLKDGLPALFVPSSGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 174 - protein, 574 aa, Meripilus giganteus
RPTVFDAGADAHSLHARAPSGSKDVIIQMFEWNWDSVAAECTNFIGPAGYGFVQVSPPQETIQGAQWWTDYQPVSYTLTGKRGDRSQFANMITTCHAAGVGVIVDTIWNHMAGVDSGTGTAGSSFTHYNYPGIYQNQDFHHCGLEPGDDIVNYDNAVEVQTCELVNLADLATDTEYVRGRLAQYGNDLLSLGADGLRLDASKHIPVGDIANILSRLSRSVYITQEVIFGAGEPITPNQYTGNGDVQEFRYTSALKDAFLSSGISNLQDFENRGWVPGSGANVFVVNHDTERNGASLNNNSPSNTYVTATIFSLAHPYGTPTILSSYDGFTNTDAGAPNNNVGTCSTSGGANGWLCQHRWTAIAGMVGFRNNVGSAALNNWQAPQSQQIAFGRGALGFVAINNADSAWSTTFTTSLPDGSYCDVISGKASGSSCTGSSFTVSGGKLTATVPARSAIAVHTGQKGSGGGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 175 - protein, 671 aa, Chaetomium megalocarpum
LYINGSVTAPCDSPIYCQGEILKAIELARPFSDSKTFVDMPTIKPVDEVIAAFSRLSQPLSNNSELTAFLAENFAPAGGELEEVPISELETDPSFLNKLEDVDIKEFVGKVIDIWPDLTRRYAGPGNCSQCANSFIPVNRTFVVAGGRFREPYYWDSYWILEGLLRTGGAFTQISKNMIENFLDFVETIGFVPNGARIYYLNRSQPPLLTLMVKTYVDYTNDTSILERALPLLVKEYEFWTNNRTVSITATDGKEYTLNRYSVNNNQPRPESYREDYVTANNASYYAQSGIIYPVKTPLNETEKAELYSNLASGAESGWDYTARWLKTPDDAARDVYFPLRSLNVRSIVSVDLNSILYQNEVIISEYLEQAGNSSEAKRFADAAEQRSEAMYALMWNATHWSYFDYNLTDNSQRVFVPADADTAPSDQTAAPPGQQVLFDIAQLYPFWTGAAPASLKANPLAVQNAYARVARMLDTKAGAIAATNLRTGQQWDQPNVWPPLQHILMKGLLNTPATFGTEDPAYAHTQDLALRLAQRYLDSTFCTWYATGGSTSATPQLQGAAPGATGTMFEKYADDATNVAGGGGEYEVVEGFGWTNGVLIWAADVFGDRLVRPDCGNITAAHTHSSEKRTVAGASRPDAGASGVRRERRAVELDPWDAAWTKMFGRSKLR

SEQ ID NO: 176 - protein, 662 aa, Lecanicillium psalliotae
LYQNGSVIAPCDSPIYCHGDILKEVELARPFTDSKTFVDMPAKKPLAEIQAAFDKLEKPLSNNTALNEFLSTYFEDAGGELKAVSKDKLKTDAKFVDKLNDTVIKEFVNKVIDIWPDLTREYAGSATNCTNCPNSFIPVNRTFVVAGGRFREPYYWDSYWIVEGLLRTGGAFVDITKNTIENFLDLIEQFGFIPNGARLYYLNRSQPPLLSQMVKNYISYTNDTDILKRALPILVKEHEFFMNNRSVEITVENKTYTLNRYAVSNTQPRPESFREDYNTVNNNSYYAASGIIYPVKTPLNESEQATLYANLASGAESGLDYTTAKWSTNPRDSMEDIYFPLRSLNIMNIVPVDLNSILYGNEKAISEFYNITGNSSEADSWSKKAAERQEAIQAVFWNETLYSYFDYNRTSSSQHIYIPSDDDTQSFENATAPAGMQEVFTVTQFYPFWMGAAPDYIRNNPHAVKTAYSRIAKYLELKPGGIPSSNLRSGQQWDQPSVWPPLMHVLMKGLVNTPATFGKEDPAYKDVHKLALTLGQRYLDSTFCTWYATGGSTSETPQLSGLSDSDVGIMFEKYDDTSINHAGGGGEYEVVEGFGWSNGVLMWVADTFGNELKRPDCGNITAANVHPGKRSVSAVELSSRDAQRVKKFGRRAEGRMKVPGVL

SEQ ID NO: 177 - protein, 637 aa, Doratomyces sp.
LYTNGSIIAPCDSPIYCHGDILHQVQLAHPFPDSKTFVDMPAIKSVDEIQAAFDKLDKPLKNDTALQNFLAENFAEAGHELAEVDPSELSTDPRFLDKVSDTVIHEFTQKVIDIWPDLTRSYSPSGAGSDCPDCPNSFLPVNRTFVVAGGRFREPYYWDSYWIVEGLLRTGGDFLGVSRNIIENFLDFVDDFGFVPNGARRYYLNRSQPPLLSLMVKSYVEQTNDTEILDRAVPLLIKEYEFWTKNRTVEVPFGNETITLNQYNVDNTQPRPESYREDYITATNASYYSASGEVYEEVEKLNETQRATVYRNLATGAESGWDYTSRWMARPRDAVEDVYFPLRSLNIIEIVPVDLNSILYANELAIAEFVRLAGADDCEEEAAAWEALAEKRSADMHRLMWNDTLHSYFDYNLTSSSQNVYVPADNDTAPFERPGGTPEGSQVFFSAAQFYPFWTGAAPSSLRDDPAAVQLAYSRVASYLDLRAGGIPATNLRTGQQWDQPSVWPPLMHILTSGLLNTSPASASDDDDPSYAPTRDLALSLAQRYLDSTFCTWYATGGSTSETPQLDGFTDEDKGAMFEKYDDSATNVAGGGGEYEVVEGFGWTNGVLIWMVDTFGDELSRPDCGDIEAANAHPARK

SEQ ID NO: 178 - protein, 601 aa, Mucor moelleri
IQNHTSFSCDSPIYCEGDILHTVQLAKIFSDSKTFVDMPTSKSESQVIEAFKAIGGRNATIAQVQQFLNENFLTAGTEVKRLTNITIPELNWIDNITDPDYRGWISKLNQAWSNLTFTFDTSVLCQDCATSTLPVSRPFVVPGGRFREFYYWDSFFVIKGLLLSDQVELAKNMILNFFDFIDTYGFIPNGARIYYLNRSQPPFLTQMVEAFWEKTSDKEFMTNALPFLDKEYNFWMTNNSISVPDPKNPSKKYKMNHYVTLNTSPRPESYVEDYNTVNNGTDYSQAVKLQLYADIAAGAETGWDYSSRWTRQKHPAPNQTEGYEMLRSINTANIVPIDLNSLLWNTETMLAEWHDRFGEKSKSKKKSAYYQTQAKKRLDAMEKLMWNPTDYTYYDYNLTSSSQNLEFTPANLFPIWLGALPNKVMKNKTELARVFDETENALRKYPGILTTSYYNTTMQWDWPNGWPPLSYVAMEGMNKVEESLNGKKGSKQDGKTYTTSRGTSLARLSFTLAERYAASAYCGWYKTGGSIPGILNKIDGVADDGHMFEKFDVNTIGISGSQGEYVSQTGFGWTNGIALWIFDTYANLTAPDCNQTITLNI

SEQ ID NO: 179 - protein, 650 aa, Phialophora cyclaminis
LYINGSVIAPCDSPIYCHGELLKAIELARPFSDSKTFVDMPTRKPVDEVVAAFEKLSKPVVNDTKLGEFLQANFLPAGGDLSDFPPGSLETDPKFLDNINDTVIREFTEAVIDIWPDLTRRYVGASNCTGCANSFIPVNRTFVVAGGRFREPYYWDSYWIIEGLLRTGGNFVQISKNIIENFLDFVETIGFVPNGARIYYLNRSQPPLLTAMVKAYLEHTNDTKILDRAVPLLIKEYNFWITNRSVTLTGPDGNEYTLQRYSVNNNQPRPESYREDYNTANNKSYYSTSGIIYPENVSLNDSEKKELYANLATGAESGWDYGTRWLSRPADALRDVYFPLRYVKTRDLVPVDLNAILYQNEASISSFLYIQGNDTGAAHFAKLAAARQKAMTAVLWNATLFSYFDYNMTSSSHFSFIPVDDDATSIETATAPRGFQQIFHVAQLYPFWTGAAPASLRENPLAVQRAFSRVSQMLEEKAGSIPATNFYTGQQWDEPNVWPPLQHIIMEGLRNTPATFGEDDPIYQGVQDLALRVAQRYLDSTFCTWYATGGSTSLTPKLAGLTDNAKGIMFEKYGDNSTNVAGGGGEYEVVEGFGWTNGVLIWAVDTFGNKLKRPDCGDIQPAHVEARGLQRRAVELDKWDAQWVKRFGAK

SEQ ID NO: 180 - protein, 654 aa, Thielavia arenaria
LYINGSVIAPCDSPLYCHGDILKAIELARPFQDSKTFVDMPTIRPVEEVIAAFNRLSQPLSNNSELNAFLQANFAPAGGELEEVPESELSTNPVFLDKLNDTVIKEFVAKVIDIWPDLTRRYAGPGNCSECADSFIPVNRTFVIAGGRFREPYYWDSFWILEGLLRTGGAFTEISKNMIENFLDFVETIGHIPNGARIYYLNRSQPPLLAGMVKNYVDYTNDTSILERALPLLIKEYEFWTNNRTVQVTASDGKTYTLHRYNVNNNQPRPESYREDWITANNASYYAASGIIYPVKTPLNESEKAALYSNLASGAESGWDYGTRFLMRPEDAARDIYFPLRHLNVRDMVTVDLNAILYQNEVIISEYLEQAGNNTEAERFASAARQRSEAMYALMWNETLWSYFDYNLTSNSQYTFIPADVNATAAEKANAPEGQKVIFHIAQLYPFWTGAAPDQLKNNPLAVQKAYSRVAEMLDIKPGAIPATNFITGQQWDQPNVWPPLMHVLMAGLLNTPPTFGEDDPAYQAVQALALRLGQRYLDSTFCTWYATGGETSQTPRLQGVSPDATGTMFEKYADNAINVAGGGGEYEVVEGFGWTNGVLIWAADVFANGLKRPDCGNITAAHTHNGAKRAVELHPRDAAWTKKFGKRALKKRA

SEQ ID NO: 181 - protein, 661 aa, Thielavia antarctica
LYVNGSVTAPCDSPLYCQGEILKAIELARPFADSKTFVDMPTLRPLDDVIAAFRKLSQPLSNSSELNAFLAANFAPAGGELEEVPKSELRTKPAFLDKVEDVVIKEFVGKVIDIWPDLTRRYAGPGNCTECANSFIPVNRTFVVAGGRFREPYYWDSYWILEGLLRTGGDFTKISRNIIENFLDFVDTIGFVPNGARIYYLNRSQPPVLTLMVKTYVDYTNDTSILERALPLLIKEHEFWTTNRSVSVEVDGKTHTLNRYFVNNNQPRPESYREDWITANNASYYAASGIIYPVKTPLNGTQQAELYANLASGAESGWDYTSRWLKTPSDAARDVYFPLRSLNVINTIPVDLNSILYQNEVIISEYLEQAGNKSGAEKFSDAARQRSEAMYALMWNATNWSYFDYNLTSSGQNTHFPADADATAAETTSSPAGTQLLFSVSQLYPFWTGAAPQQLKSNPLAVTQAYARVAAMLDAKAGAIPATNLLTGQQWDEPNVWPPLQHVLMQGLLNTPATFGADDPAYQATQALALRLAQRYLDSTFCTWYATGGSTSATPRLAGVSAGAEGSMFEKYGDDSTNVAGGGGEYEVVEGFGWTNGVLIWAADVFAGKLQRPECGDIEAAQTHGGAARRGLGMERRAIELDPWDARWTKAFGKRALRRRA

SEQ ID NO: 182 - protein, 667 aa, Chaetomium sp.
LYINGSVTAPCDSPLYCQGEILKAIELARPFSDSKTFVDMPTIKPVDDVIAAFSRLSQPLSNNSELNAFLAENFAPAGGELEEVPESELETDPAFLDKLEDTTIKEFVTKVIDIWPDLTRRYAGPGNCSKCANSFIPVNRTFVVAGGRFREPYYWDSYWILEGLLRTGGAFTEISKNIIENFLDFVDTIGFIPNGARIYYLNRSQPPLLTLMVKTYVDYTNDTSILERALPLLIKEHEFWTNNRSVAITAADGKKYTLQRYYVNNNQPRPESFREDYITANNASYYAASGIIYPVKTPLNETEKAELYSNLASGAEAGWDYTARWLKTPNDAARDVYFPLRSLNVIGMVPVDLNSILYQNEVIIAEYLQQAGNSSEARRFATAAEKRSEAMYALMWNSTHWSYFDYNLTSNSQRIFVPTDADADPVDQTNAPPGHQVLFDIAQLYPFWTGAAPASLKNNPLAVQLAYARVAHMLDTKAGAIPGTNFRTGQQWDQPNVWPPLQHVLMKGLLNTPPTFGEADPAYQEVQRLALRLAQRYLDSTFCTWYATGGSTSDMPQLQGVNPGATGTMFEKYADNATNVAGGGGEYEVVEGFGWTNGVLIWAADVFGEGLTRPDCGNITAAHTHSGAKRGLDGGEGGAGGLWGRRAVELDPWDARWTKMFGRRKRE

SEQ ID NO: 183 - protein, 671 aa, Chaetomium nigricolor
LYINGSVTAPCDSPLYCQGEILRAIELARPFSDSKTFVDMPTIKPLEEVIAAFNQLTQPLSNNSELNTFLAENFAPAGGELEEVPKDELNTDPGFLDKLNDTTIREFVAKVIDIWPDLTRRYAGGGNCSECANSFIPVNRTFVVAGGRFREPYYWDSYWILEGLLRTGGAFIEISKNIIENFLDFVETIGFIPNGARIYYLNRSQPPLLTLMVKTYVDYTNDTSILERALPLLIKEHEFWVNNRSVEITAANGQTYTLNRYHVNNNQPRPESYREDYITANNGSYYAASGIIYPVRTPLNETEKAELYANLASGAESGWDYTARWLKTPNDAANDVYFPLRSLNVRGLVPVDLNSILYQNEVIIAEYLQQAGNLSLAQRFAEAAEQRSEAMYALMWNATYWSYFDYNLTSNSQRIFVPLDADSRTIETVGAPPGHQVLFDIAQLYPFWTGAAPANLKNNPLAVQQAYSRVASMLDAKAGAIPATNFRTGQQWDQPNVWPPLQHILMQGLLNTPPTFGDSDPAYQHVRDLALRLAQRYLDSTFCTWYATGGSTSDMPQLQGVSPDATGTMFEKYADNATNVAGGGGEYEVVEGFGWTNGVLIWAADVFGDALKRPDCGDIEAAHTHQAKKRDVEGLERRAVELDPWDAAWTKMFGRSKLRKRGAGGQKRWVS

SEQ ID NO: 184 - protein, 666 aa, Chaetomium jodhpurense
LYFNGSVIAPCDSPLYCQGEILKAIELARPFSDSKTFVDMPTIKPVDEVIAAFNRLSQPLTNNSELNAFLAENFAPAGGELEEVPKDELNTDPKFLDKLEDATIKEFVAKVIDIWPDLTRRYAGASNCSECANSFIPVNRTFVIAGGRFREPYYWDSYWILEGLLRTGGAYTQISRNMLENFLDFVETIGFIPNGARIYYLNRSQPPLLAMMIKNYVDYTNDTSILDRALPLLIKEHEFWINNRSVSITAADGKQYTLHRYNVNNNQPRPESYREDYITANNASYYAASGIIYPVKTPLNESEKAELYANLATGAESGWDYTARWLKTPNDAAKDVYFPLRSLNVRGMVSVDLNSILYQNEVIIAEYLERAGNISEAERFAAMAQQRSEAMYALMWNSTHWSYFDYNLTSNSQRIFVPLDDDSSTAEQANSPPGHQVLFDIAQLYPFWTGAAPESLKSNPLAVQLAYSRVARMLDTKAGAIPATNFRTGQQWDQPNVWPPLQHVLMAGLLNTPPTFGESDPAYQNVRALALRLAQRYLDSTFCTWYATGGETSQTPRLQGVSPDATGTMFEKYADNATNVAGGGGEYEVVEGFGWTNGVLIWAADVFADGLKKPDCGNITAAHTHSAKRGLERRAVELDPWDAAWTKMFGRSKLRKREEGRKRWLS

SEQ ID NO: 185 - protein, 670 aa, Chaetomium piluliferum
LYINGSVIAPCDSPLYCHGEILKAIELARPFSDSKTFVDMPTIKPLDEVIAAFSQLSQPLSNNSELNAFLAENFAPAGGELEEVSKDELQTDPTFLDKLDDTTIKEFVSKVIDIWPELTRRYVGSSDCSGCANSFIPINRTFVVAGGRFREPYYWDSYWILEGLLRTGGAFVDISRNIIENFLDFVETIGFVPNGARIYYLNRSQPPLLTLMVKTYVDYTNDTSILERALPLLVKEHEFWTTNRSVSITANGKEYTLNRYSVNNNQPRPESYREDYITASNESYYAESGIIYPVRTPLNETEKAELYSNLASGAESGWDYTSRWLKTPNDAANDVYFPLRSLNVLGLVPVDLNSILYQNEVILAEYFEQAGNSSEAERFAAAAEQRSEAMYDLMWNATHWSYFDYNLTSSSQRIFVPLDDGASTQEQSTSPPGYQVLFDVAQLYPFWTGAAPAALKSNPLAVQHAYSRVADMLNTKAGAIPATNFRTGQQWDQPNVWPPLQHIIMQGLLNTPPTFGESDPAYENTQSLALRLAQRYLDSTFCTWYATGGSTSDMPPLQGVSAGATGTMFEKYADDATNVAGGGGEYEVVEGFGWTNGVLIWAADVFGDALKRPDCGNITAASTHEGATKRDLRGLGRRAVELDPWDAAWTKMFGRAKLRKREQGRETWVN

SEQ ID NO: 186 - protein, 674 aa, Myceliophthora hinnulea
LYINGSVTAPCDSPIYCHGELLKGVELAHPFVDSKTFVDMPTLKPVDEVLAAFSKLRQPLSNNSELNNFLAEYFAPAGHELEEVPDSELQTDPKFLDKLEDRTIKEFVSKVIDIWPDLTRRYAGPGDCSDCANSFIPVNRTFVVAGGRFREPYYWDSYWILEGLLRTGGAFTQISKNIIENFLDFIDTIGFIPNGARIYYLNRSQPPLLTRMVKSYVDYTNDTSILERALPLLIKEHDFFTNNRSVSVTASNGKTYTLHRYHVENNQPRPESYREDYITANNGSYYAASGIIYPVKTPLNETEKAVLYSNLASGAESGWDYTARWLRVPDDAARDVYFPLRSLNVREIVPVDLNSILYENEVIIAGYLEKAGNSSEAKRFASAAKQRSEAMYNLMWNATHWSYFDYNLTSNAQNIFIPADEDTAPFDRTAAPPGKQVLFHIAQLYPFWTGAAPAHLKSNPLAVQKAYARVSRMLDSKKGAIAATNYRTGQQWDQPNVWPPLQHVLMQGLLNTPATFGESDPAYQGVQKLALRLAQRYLDSTFCTWYATGGSTSDFPQLQGVSPDATGIMFEKYADSAINVAGSGGEYEVVEGFGWTNGVLIWAADVFGNKLKRPDCGNITAAHTHSEAKRSLGDGGLARRAVELDPWDAAWTKMFGRSKLRRREAEDVRKRWSS

SEQ ID NO: 187 - protein, 659 aa, Chloridium virescens
LYINGSVIAPCDSPLYCQGDILKAIQLAQPFSDSKTFVDMPTTQPVDQVIAAFNQLPQPVSNNSGLQNFLSTYFAPAGGELTEVPKDQLQTNPMFLNKLNDTVIREFVTAVIDIWPDLTRTYTGASNCTGCSDSFIPVNRTFVVAGGRFREPYYWDSFWILQGLLRTGGAFTQISKNIIENFLDLVDQFGFVPNGARVYYLNRSQPPVLSEMVRTYVAYTNDTSILARAIPTLIKEHNFWMQNRTVNITGADGNTYTLNQYHVENTQPRPESYTEDYITANNHSYYATSGIIYPETKPLNDSEIANLYANLASGAESGWDYGSRYLARPNDAAQDVYFPLRSLNVLNIVPLDLNSLLYQSEQNIALFLQATGNSSEAEQWTSLAAQRQTAIHALMWNETLWSYFDYNLTSNGQNIYVPADKDATPADTASAPPGYQVLFDVAQFYPFWTGAATDELRRNPLAVRQAFTRVDAYLTAKAGGIPATNLMTGQQWDQPNVWPPLMHVLMQSLLDTPATFGAADPSYAALQGLALRLAQRYLDMTFCTWYATGGSTSQTPKLQGLGPDAVGTMFEKYADNATNIAGSGGEYTVVEGFGWTNGVLIWAADTFGAQLTRPNCGNITAAHVTPGKRSVGLGRRAVELHESDARWVKMFGSRAWRNA

SEQ ID NO: 188 - protein, 662 aa, Gelasinospora cratophora
LYVNGSVTAPCDSPIYCYGELLHQVELARPFSDSKTFVDMPTIKPVDEVLEAFSKLTLPLSNNSELHEFLNTYFGPAGGELEAVPTDQLHVSPTFLDNVSDDVVKQFVNSVINIWPDLTRKYVGAGEICTGCANSFIPVNRTFVVAGGRFREPYYWDSFWILEGLLRTGGAFTEISKNTIENFLDLVEQIGFVPNGARLYYLNRSQPPLLTQMVRIYVEHTNDTSILERAVPILKKEWEWWITNRTVEVTADGKTYSLQRYHVDNNQPRPESYSEDYITANNNSYYATSGIIYPETTPLNDTQKAQLYANLASGAESGWDYSTRWLKNPNDAARDVYFPLRSLNVLEIVPVDLNSILYQNEVTIGKFLAQQGNKDEAEEWAKKAEQRSEAMYKLMWNSTLWSYFDYNLTSSSQNIYVPADPQVFPFEKPSGTPEGYQVLFSINQMFPFWTGAAPDQLKANPLAVKLTFDRVKNYLDNKAGGIPATNFVTGQQWDEPNVWPPLMHVLMDGLLNTPATFGEDDPAYQETQNLALRLAQRYVDSTFCTWWATGGSTSETPKLQGLGSDAKGIMFEKYADNSTNVAGGGGEYEVVEGFGWTNGVLIWAADKFGDKLKRPNCGDLTPANVGKRAVELDAFDAKFTKKFARKGKLEKLKAKFKRRAAI

SEQ ID NO: 189 - protein, 543 aa, Acidobacteriaceae bacterium
QTTTTSAGLHDTLAYIKRTWHTLERSNKTLLKSADDVKVGQAGTLTLYVSQDVKPQAVNASLRRELPPADKKRIVVRQLPEHPEAVEPAGLLYLPYPYVVPGGRFNEMYGWDSYFILLGLVHDDELALAKNMTDNFIYEIEHYGMILNANRTYYLTRSQPPFLTQMILEVYRRTGDGKWLASTLPAIEKYYAYWMREPHLTPETGLSRYWGGADTPAPEVVHGEKDAAGHNQYDRVREYYRTHNVTAYDVSQYYDKATDRLKPLFYIADRAMRESGFDPSSRYGPFSADIIHYDPVCLNSLLYRMESDTATILKQLNRTSEARVWEKRATQRAELVNRLMWNEEKGLYFDYDFITRRQSNYHFVTTFYPLWAGIASRQQADRVRKNLSIFERAGGLQTSDYISGSQWDAPFGWAPLQIMTVEGLRRYGFNEDADRISRKFINMVVRDFEEHGTIKEKYDVVIGKSDLAAGLKFGYTSNEAGFGWTNAAVVLFIEELAGERPLAASLDRESMPMLRQRHLSPQPSVWPPFSPQAPQYRRRDPYR

SEQ ID NO: 190 - protein, 532 aa, Acidobacterium capsulatum
GARSSLSPHAVAGPQPIDAYIHTAWSTLTRSMSDCKSVADPKLKSTPVLYLPRDLAVPANVAAMQKQCHVRVLRLPIVITHFDQIRESQIATPGLLYLPHPYVVPGGRFNEMYGWDSFFILKGLLDDHHIALARGIVENFFFEIAHYGGILNANRTYYFTRSQPPFLSSMIRAIYAAEVAEGHTQAAHAWLVEAYPYAVRDHALWMSPIHQAGNTGLARYFDTGQGPVPEMADDSTYYQDVIRWLLAHPGLHTGYLMHGSPHLDAAARERLAQLSCDPTLSKVCARAHVHGYWLTRSFYKGDRAMRESGFDTTFRFGPFSGSTQHFAPVGLNALLYKYERDLAWMAAQLGKPGEAAKWNSEAETRRAEMNHYLWNAQKKMYFDYNFETHRQSSYAFITTFYPLWAGAADKAQQQGVIASLPLFEHPGGLAISNHDSGVQWDLPYGWAPTEWMAVQGLLRADDQHDARRIASEFNRTVRTTYQHDHAIYEKYDVVNRSNDFRVTAGYTQNVVGFGWTNAVYLEFQSLLAHPGQ

SEQ ID NO: 191 - protein, 568 aa, Acidovorax wautersii
AAAVSSGLRISERHPAYSTNPARVQVPGAPGAPPSDHCTPADRYQELFVAVQSQQIFEDSKTFVDCGPIGEPEDILAAYRAEHAQPDFDLARFVAQHFTAPQVAANDYVGAPGMALAEHIDALWPVLTRKPEDHPVRGSALPLAHPYVVPGGRFAELYYWDSYFTMLGLAATGRSELVQCMTDNFARLIDAFGFVPNGTRTYYLSRSQPPLFAAMAELGALVGGPPVSHYLPQLLQEHAWWMDGLHVLHPGEARRRVVALPGGEILNRYWDDRDTPREESWREDIETASAVDRPSADVYRDLRAAAESGWDFSTRWLRAPDAANPASLHLSQICTTDLLPVDLNAFLYRMEVSIAKASQSAGDRATATHFHDLAAHRREAVNRLMWNEAEGAYFDYDWRRGELRGCLTAATVVPLYAGMATEAQAAAVARAVRTHLLAAGGLATTVCSSDQQWDRPNGWAPLQWMAVRGLERYGHKDLALEVRQRWIETVRSVYQREGKLVEKYAVGNGDGAPLCGGGGGEYPLQDGFGWTNGVVQCWLDPRYDTYAAAQTVYYGPTDDGTADSLPEA

SEQ ID NO: 192 - protein, 529 aa, Xanthomonas arboricola
APMDTPVVNAPAATPPTPDLAYPELFQAVQSGELFDDQKHFVDFLPLRDPALINADYLAQHDHPGFDLRKFVDANFEESPPVQTDAIRQDTALREHIDELWPKLVRSQTHVPPYSSLLALPHPYVVPGGRFREVYYWDSYFTMLGLVKSGETTLSRQMLDNFAYLIDTYGHIPNGNRSYYLSRSQPPFFSYMVELQAGVEGEAVYQRYLPQLRKEYAYWMQGSEDLQPGQAARHVVRLADGSLLNRYWDERDTPRPEAWLHDTRTAAEAGDRPAAEVYRDLRAGAESGWDYTSRWLADGQNLRTIRTTAIVPIDLNSLLYHLERTLAQACAQPGAECAQDYAALALRRKQAIDAHLWNAAGYYADYDWQTRKLSDQVTAAALYPLFTGLATDAHAKRTASTVRARLLRPGGLATTAVKTGQQWDEPNGWAPLQWVAVDGLRRYGEDALARTIGERFLTQVQALFAREHKLVEKYGLEADAAGGGGGEYALQDGFGWTNGVTLMLLNLYPDTATKPAPAKRARKPEAAAR

SEQ ID NO: 193 - protein, 540 aa, Kosakonia sacchari
AEAQNTPQPPDILLGPLFSDVQTAKLFPDQKTFADAVPKGDPLMILADYRMQRMQTSFDLRHFVDVNFTLPKEGEKYVPPEGQNLREHIDGLWPVLTRTTDSAGKWDSLLPLPKPYVVPGGRFREVYYWDSYFTMLGLAESGHWDKIEDMVTNFAHEIDTWGHIPNGNRSYYLSRSQPPFFSLMVELLATHDGDEALKTWLPQMEKEYQYWMEGADTLQPGQANKRVVKLSDGSVLNRYWDDRDTPRPESWLDDVTTAKNNPNRPATEIYRDLRSAAASGWDFSSRWMDDPNQLGTIRTTSIVPVDLNALMFKMEKMLARGYQAAGDSAKASQYDALANARQKGIEANLWNEKEGWYADYDLKTKKVRNQLTAAALYPLFVNAAAKDRADKVASAAKERLLKPGGIATTTVNSGQQWDAPNGWAPLQWVATAGLQNYDQQKLAMEVSWRFLTNVQHTYDREKKLVEKYDVSTTGTGGGGGEYPLQDGFGWTNGVTLKMLDQICPKEKPCDSVPQTQPAQQPAAKVEPTSQPSKQQQAVAQ

SEQ ID NO: 194 - protein, 532 aa, Enterobacter sp.
DEQPAFQKNSPDILLGPLFNDVQSAKLFPDQKTFADAVPKSDPLMILADYRMQHTQSSFDLRHFVEMNFTLPAEGEKYVPPAGQSLREHIDDLWPVLTRTTDKASNKWDSLLPLPKPYVVPGGRFREVYYWDSYFTMLGLAESGHWDKISDMVDNFAWEIDTFGHIPNGNRSYYLSRSQPPFFSMMVELLATHDSDALKKYRPQMEKEYAYWMEGVDSLQPGQANQRVVKLDDGSVLNRYWDDRDTPRPESWLDDVNTAKNNPNRPATEIYRDLRSAAASGWDFSSRWMDDPQKLGTIRTTSIVPVDLNALMFKMEKLLARASQEAGDSAAASKYEALATARQKAIENHLWNDKEGWYADYDLKSKKVRNQLTAAALFPLYVKAASQERADKVAAATSARLLKPGGITTTTINSGQQWDAPNGWAPLQWVATEGLQNYGQNKVAMDVTWRFLKNVQHTYDREKKLVEKYDVSTTGTGGGGGEYPLQDGFGWSNGVTLKMLDLVCPKEKPCDSVPENQPAANDEAAPVKASAQ

SEQ ID NO: 195 - protein, 720 aa, Saitozyma flava
QNPASSSSFSPTPVTTMVPSPTAALNATVPGQGVYPPLQAWCNNGGNDTFCPGVLLQDVQLSGIFPDSKTFVDKPTRGTLNETLRTFASLGNNLTVGQIEGFVNNSFKGEGLELSQVALEGFNPNPAFLDTISDPIYQGWMSVVNSYWTLLIRETNRSALCNGDCESSLIPLNNTIVVPGGRYREIYYWDSYWILIGLLESELTAYATDLISNFMDFIQTYGFIPNGGRKYYLNRSQPPVFTQMLNTYVQRTGNTSILARGLPLAHQELVWWENNRVISVTSPYSNITRRVAHFAVNNTAPRPEGYVEDYETAFGASPALNETARGQLYSDLAAGAESGWDYSSRWCKQPVINLTDNFPALRTINTAKIIPVDLNSLLAGDHTLLANLYELYGNSSNANTSVTSNSSQLVPYHRQLAKNYSDAVLDLHWDAQKAWFYDFNLTANARADIYHPGGTFALWQNITPPAVASNETYALEVVSGARFLLGKYTSIPSVSTLIETGLNWDFPNSWPPHVYSSIKAFETLGRAFPNASVLSNISIPFSDVQKNQLGLDESAIPAQPASTIGNSTSQIAEAQGKPWPQALSIEYANRYMQAAFCSWYSTGGSIDGLLTQLPLSELNMTGTFQAGTTGVMFEKFNVTDLDAAGGGGEYKVQIGFGWTNGVALWLGANFGQYLPQPTCPLIPIIEVQNGMNSSVYQNGTMTNSTKTQSYIFQGHRIPRK

SEQ ID NO: 196 - protein, 723 aa, Phaeotremella skinneri
QTPTSSSSSSFSATPVSTSVPSPTVPLNSSVIGQGLYPPAQAWCNGGMNDTFCPGVLLQDVELSGIFADSKTFPDKPTVGTLNSTLQAFAALPANVTVGEIETFVNQYFKGEGLELEQVAIEGFVANPAILNNITDPVFKGWVSTVNGYWQLLIRQTNESSLCNETSCASSLIPLNHTIVVPGGRYREIYYWDSFWILQGLLKSELYTYSWDLLQNFMDLIETYGFLPNGGRKYYLNRSQPPVFIQMLDAYIKVTGNSSILARALPIATTELAWWSSNRTIPVTSPYTGITHLVAHYAVTNSAPRPEGYVEDFTTAMGASPALNDSARAELYSELASGAETGWDYSSRWCRQPLLNLTDNNPALRTLNVKAIIPVDLNSLLAGDHALLANLYDLYSNSSSSNSTSNSSSISNSSSQAAYHRQAAQNLTAAILDLHWSPSKSFFYDFNTSSNSQSDIYTPASLFPLWQNITPPALVGNETAALQLVSGVRYLLGKYAGIPSVATLLATGLNWDFPNSWPPHVYTSIKAFQTLYRVNPNATVLSNLTLSFAQVQAGQLGLSETGFQIQPASTVGNTSLETAEAKGKPWPVALGIEYANRYMQSAFCSWYSTGGEISGVLTQLPLSDLNSTGTFTAGQTGVMFEKFNVTDPDAAGGGGEYTVQTGFGWTNGVVLWVAGEFGSLLPAPTCPLIPIIEISGSSNSSIYANGTVTNSTALYRGYKIPRK

SEQ ID NO: 197 - protein, 663 aa, Trichoderma asperellum
LYTNGSVIAPCDSPIYCHGDILQDIQLAHPFSDSKTFVDMPAKRPLREIQSAFNNLSKPLTNDSSLQVFLETYFADAGGELVEVPRSSLTTNPAFLNKINDTVIREFVTKVIDIWPDLTRRYSGAVGNCSTCPNSFIPVNRTFVVAGGRFREPYYWDSYWIIEGLLRTGGAFVGIAKNTIENFLDFIDRFGFIPNGARLYYLNRSQPPLLSQMVRIYIEHTNDTSILKRALPLLVKEHDFWIRNRTISVNIANKTYTLQQYAVQNTQPRPESFLEDYVTANNRSYYATSGIIYPENKHLNSTEMADLYANLATGAESGNDYTSRWLANPSDAINDVYFPLRSLNNKEIVPVDLNSILYGNELTISQFYNRTGDATAARAWAERAANRSAAIQAVFWNETLFSYFDYNLTSSSQYVYVPADKDTISLDRQTAPSGKQVFFHVGQFYPFWTGAAPDYVKNNPYAVTRAYDRVTGYLDAQPGGIPASNVQTGQQWDQPNVWPPHMHILMQGLNNVPATFTAQDPSYQDIQNLSLRLGQRYLDFTFCTWLATGGSTSETPKLHGLSDQDVGIMFEKYDDNSTNAAGGGGEYEVVEGFGWTNGVLLWTADTFGNKLKRPQCGNITAGHPAPASSSSKRSAVQLDAWDARRVKKFGKRTEGRVKRPFLF

SEQ ID NO: 198 - protein, 674 aa, Corynascus sepedonium
LYINGSVTAPCDSPIYCQGELLKAVELARPFVDSKTFVDMPTIKPVDEVLAAFSKLSLPLSNNSELNAFLYENFAQAGHELEEVPDSELETDAKFLDKLEDRTIKEFVGKVIDIWPDLTRRYAGPSNCTECANSFIPVNRTFVVAGGRFREGYYWDSYWIVEGLLRTGGAFTHISKNIIENFLDFVDTIGFIPNGARIYYLNRSQPPLLTLMVKSYVDYTNDTSILDRALPLLIKEHEFFMNNRTVSITGSNGKEYTLNRYHVENNQPRPESFREDYITANNGSYYASSGIIYPVKTPLNETEKAALYSNLATGAESGWDYTSRWLGVPSDAARDVYFPLRSLNVRDIVPVDLNSILYQNEVIIAEYLEKAGNSSAAKRFATAAEQRSEAMYSLMWNATHWSYFDYNLTDNTQHIFVPADEDTAPQDRIEAPPGQQVFFHIAQLYPFWTGAAPASLKANPLAVQQAYARVARMLDIKKGAIPATNYRTGQQWDQPNVWPPLQHILMKGLLNTPATFGKSDPAYQSVQNLALRLAQRYLDSTFCTWYATGGSTSDFPQLEGVTPGATGVMFEKYADNATNVAGTGGEYEVVEGFGWTNGVLIWAADVFGNKLKRPDCGNITAAHTHSSAKRGLEENKLPRRAVELDPWDAAWTKMFGRSKLRRREAEDVRKRWMS

SEQ ID NO: 199 - protein, 674 aa, Myceliophthora thermophila
LYINGSVTAPCDSPIYCHGELLKGVELAHPFVDSKTFVDMPTLKPVDEVLAAFSKLRQPLSNNSELNNFLAEYFAPAGHELEEVPKGELQIDPKFLNKLEDRTIKEFVSKVIDIWPDLTRRYAGPGDCSGCANSFIPVNRTFVVAGGRFREPYYWDSYWILEGLLRTGGAFTQISKNIIENFLDFIDTIGFIPNGARIYYLNRSQPPLLTRMVKSYVDYTNDTSILERALPLLIKEHDFFTNNRSVSVTASNGKTYTLHRYHVENNQPRPESYREDYITANNGSYYAASGIIYPVKTPLNETEKAVLYSNLASGAESGWDYTARWLRVPDDAARDVYFPLRSLNVREMVPVDLNSILYENEVIIAEYLEKAGNSSEAKRFASAAKQRSEAMYNLMWNATHWSYFDYNLTSNAQNIFVPADEDTASFDRYAAPPGQQVLFHVAQLYPFWTGAAPAHLKSNPLAVQKAYARVSRRLDTKKGAIAATNYRTGQQWDQPNVWPPLQHVLMQGLLNTPATFGESDPAYQGVQKLALRLAQRYLDSTFCTWYATGGSTSDFPQLQGVSPDATGIMFEKYADSATNVAGGGGEYEVVEGFGWTNGVLIWAADVFGNKLKRPDCGNITAAHTHSEAKRSLGDGGLARRAVELDPWDAAWTKMFGRSKLRRREAEDVRKRWSS

SEQ ID NO: 200 - protein, 661 aa, reesei GH37
LYINGSVIAPCDSPIYCHGDILREIELAHPFSDSKTFVDMPAKRPLSEIQTAFANLPKPLRNDSSLQTFLASYFADAGGELIQVPRANLTTNPTFLSKINDTVIEQFVTQVIDIWPDLTRRYAGDAAVKNCSSCPNSFIPVNRTFVVAGGRFREPYYWDSYWIVEGLLRTGGAFVGIARNTIDNFLDFIERFGFVPNGARLYYLNRSQPPLLSRMVKVYIDHTNDTAILRRALPLLVKEHEFWTRNRTVDVRVNNKTYVLNQYAVQNTQPRPESFREDFQTANNRSYYAASGIIYPATKPLNESQIEELYANLASGAESGNDYTARWLADPSDAMRDVYFPLRSLNNKDIVPVDLNSILYGNELAIAQFYNQTGNTTAAREWSSLAANRSASIQAVFWNETLFSYFDYNLTSSSQNIYVPLDKDAVALDRQTAPPGKQVLFHVGQFYPFWTGAAPEYLRNNPFAVTRIFDRVKSYLDTRPGGIPASNVNTGQQWDQPNVWPPHMHILMESLNSVPATFSEADPAYQDVRNLSLRLGQRYLDFTFCTWRATGGSTSETPKLQGLTDQDVGIMFEKYNDNSTNAAGGGGEYQVVEGFGWTNGVLLWTADTFGSQLKRPQCGNIMAGHPAPSKRSAVQLDMWDASRVKKFGRRAEGRMGTLHAW

SEQ ID NO: 201 - protein, 670 aa, Chaetomium virescens
LYINGSVTAPCDSPLYCQGEILKAIELARPFSDSKTFVDMPTIKPLEEVIAAFGRLKQPLSNNSELTAFLAENFAPAGGELEEVPKSELHTDPVFLNKLDDAVVKEFVGKVIDIWPDLTRRYAGPGNCSNCENSFIPVNRTFVVAGGRFREPYYWDSYWIVEGLLRTGGAFVGITKNILENFLDFIETIGFVPNGARIYYLNRSQPPLLTKMIKIYVDHTKDTSILQRALPLLIKEHEWWTNNRSVTVTGPNGKTYTLNRYHVNNNQPRPESFREDYITANNGSYYATSGIIYPVKSPLNETEKDETYANLATGAESGWDYTARWLRTPNDAAKDVYFPLRSLNVRNMIPVDLNSILYQNEVIIGEYLEQAGNKSEAQRWFQAANQRSEAMYALMWNATHWSYFDYNLTSNSQYIFIANDEDATTAEQANSPPGQQVLFSISQLYPFWTGAAPDQLKKNPLAVQQAYYRIERMLNEKAGAIPSTNFRTGQQWDEPNVWPPLQHILMQGLLNTPATFGTADPAYAAVQNLALRLAQRYLDSTFCTWYATGGSTSQTPQLQGVSPGATGIMFEKYADNATNVAGSGGEYEVVEGFGWTNGVLIWAAETFGNKLKRPDCGDIQAAHTHTDKKKRWSVDGEVRARERMAVELDPWDAKWTKMFGQAKGRVGRRS

SEQ ID NO: 202 - protein, 508 aa, Rhodothermus marinus
QDRVACQVPLPSVERIEAVRAYIRQSWDVLTRSHRDLLAAVQDPKIEHEPGTPWPLYIAATEDSVAVWHRLQQELPDSVLQQIVLRVLPEDPVAHLDEIHPHGLLYLPEPYVVPGGRFNEMYGWDSYFIVVGLLRDGRVDLAKAMTDNHLYQVRHYGKVLNANRTYYLTRSQPPFLSAMVLAVYAHTQDRDWLAAAVPLIERYYAYWTTPPHLAGETGLSRYYDLGEGPAPEVVAGERDAQGRTHYDRVREYYRMHEVTAYDESLYYVAEADSLTPLFYKGDRSMRESGFDPSNRFGPFSVDIIHYAPVGLNALLYRMETDLARIHEILGDTAAAAAWRARAEARRERVDRYLWDSERGLYFDYNFRTGRRSDYVFATTFYPLWVGMASPEQAARVAANLYLLEAPGGLLTSTHISGSQWDAPYGWAPLYLIAVEGLRRYGYDEAADRLTAKFVSMIVEDFERTGVILEKYDVVQRRSDVALRYGYTSNEIGFGWTNAVFAELLAQMD

SEQ ID NO: 203 - protein, 674 aa, Myceliophthora sepedonium
LYINGSVTAPCDSPIYCQGELLKAVELARPFVDSKTFVDMPTIKPVDEVLAAFSKLSLPLSNNSELNAFLYENFAQAGHELEEVPDSELETDAKFLDKLEDRTIKEFVGKVIDIWPDLTRRYAGPSNCTECANSFIPVNRTFVVAGGRFREPYYWDSYWIVEGLLRTGGAFTHISKNIIENFLDFVDTIGFIPNGARIYYLNRSQPPLLTLMVKSYVDYTNDTSILDRALPLLIKEHEFFMNNRTVSITGSNGKEYTLNRYHVENNQPRPESFREDYITANNGSYYASSGIIYPVKTPLNETEKAALYSNLATGAESGWDYTSRWLGVPSDAARDVYFPLRSLNVRDIVPVDLNSILYQNEVIIAEYLEKAGNSSAAKRFATAAEQRSEAMYSLMWNATHWSYFDYNLTDNTQHIFVPADEDTAPQDRIEAPPGQQVFFHIAQLYPFWTGAAPASLKANPLAVQQAYARVARMLDIKKGAIPATNYRTGQQWDQPNVWPPLQHILMKGLLNTPATFGKSDPAYQSVQNLALRLAQRYLDSTFCTWYATGGSTSDFPQLEGVTPGATGVMFEKYADNATNVAGGGGEYEVVEGFGWTNGVLIWAADVFGNKLKRPDCGNITAAHTHSSAKRGLEENKLPRRAVELDPWDAAWTKMFGRSKLRRREAEDVRKRWMS

SEQ ID NO: 204 - protein, 657 aa, Moelleriella libera
LHTNGSLIAPCDSPIYCYGDILKQVELARPFADSKTFVDMPGVKPLAEIQAAFDKLEKPLRNNTALQDFLKTYFADAGQELQEVPKSELKTDPQFLKTLNDTVIREFVTKVIDIWPDLTRSYKGSNTNCTDCPNSFIPINRTFVIAGGRFREPYYWDSYWILEGLLRTRGSFTQIAKNTLENFLDFVEQFGFVPNGARIYFLNRSQPPMLSQMVKLYIDHTNDTAILQRALPLLVKEHAWWMNNRTVDVQVGGKTYKLNRYAVSNTEPRPESYREDFETASNSSYYAQSGIIYPETKKLNDSQRAVLYANMATGGENGWDFSSRWIANPSDSVRDVYFPLRTNNAQNVVPVCLNSILYGNEMTIGGFFNSTGNTTAGQEWAAKAKARSEAMHATMWNETHFSYFDYNLTSSAQDVYTLADDDTSIYDNGTLTGAPPGYQVAFNGAQFYPFWQGAAPTYLKENPQAVKTAYARVAQYLKVRKGGIPATNLKAREQWDQPNVWPPLMHILMQGLLNTPPTFGSSDPSYKSVRSMALTLAQRYLDSTFCTWYATGGSTSETPKRPGLPEKDKGIMFEKYADNSIDIAGSGGEYEVVEGFGWTNGVLIWAADTFANELKRPDCGNGSSSSSTSSAAKRGLSAVELHPADASRIKRFGSSKG

SEQ ID NO: 205 - protein, 660 aa, Acremonium dichromosporum
IYVDGNITAPCDSPVYCYGEMLHQIQLAKPFDDSKTFVDMPALKPLSQIQAAFDRLDKPLSNNSALNNFLDEFFADAGGELSEVDKADLETDPVFLDKIDDEVVKEFTNKVIDIWPDLTRRYSGAAASNCTNCPSSFIPLNRTFVVAGGRFREPYYWDTYWIIEGLLRTGGSFTDISRDIIENFLDFVDQFGFVPNGARIYYLNRSQPPVLSRMVQAYIEHTNDTDILDRALPLLMKEHEFFSENRTIDIEGPNGTTYTLNRYDVRNNQPRPESYSEDYETATNTSYYSHDSGIIYPETEPLNDTERANLYSALASGAESGWDYSSRWIARPRDAAEDVYFPLRSLNTNNIVPVDLNSIMYANEMAIAGFLNQTGNASAAAEWEELAYNRSEAIHALMWNETYMSYFDYNLTSAAQHIYVPADDDVSTLESSTAPEGHMVLFSVSQFYPFWTGAAPSYIKNNPFAIAQIYKRVETLLDTRKGGIPATNFRTGQQWDQPSVWPPLMHILMAGLQNTPATFGEDDPAYQHVHEIALRIGQRYLDSTFCTWRATGGATSETPQLEGFTDRDVGIMFEKYADNSTNIAGGGGEYEVVEGFGWTNGVLIWTVDEFGNELKRPDCGDLEAADTTERRKRSALQLAPRDAQRTKKFGKRAVERQPWF

SEQ ID NO: 206 - protein, 667 aa, Fusarium sambucinum
LYVNGTVVAPCDSPIYCHGDILEQVELARPFSDSKTFVDMPAIRPLSEIQKAFDELDKPLRNNSALADFLSENFADAGNELEEVPEDELKTDPKFLDNINDTVIREFTEKVIDIWPDLTRRYDQDSKNCSDCPNSFIPVNRSFVVAGGRFREPYYWDSYWIIEGLLRTGGSFVNIAKNTIENFLDFIEEYGFVPNGARIYYLNRSQPPLLSQMVKIYIDHTNDTDILERALPLLVKEHEFFMKNRSVPVYINDETYMLNTYNVSNTQPRPESYREDYITATNKSYYSTSGEVYSGGEELSFKQKETLYGNLASGAESGLDYTSKWIARPENAIRDNYFPLRYLNTRNIIPVDLNSILYGNEIAIADFYEQTGNSSASEQWREVAANRSYAMHAFMWNETLWSYFDYNLTSKAQQIYFPADNNTVSVDTEDAPKGQQVFFSPTQFYPFWLGAAPDYLKNNPYAVLSAYKRVATYLDKREGGIPASNIETGQQWDQPNVWPPMMHILMAGLEKVPATFGIMDPSFIEIRKLALRLGQRYLDSTFCTWYATGGSTSETPKLESVSDKEDGIMFEKYADNATNTAGGGGEYEVVEGFGWTNGVLIWAVEEFGNRLTRPKCKNLETAHSSDKRDTSAVMLHARDAKHVKKFGRRKRAEEKAAKKRSSRLFHF

SEQ ID NO: 207 - protein, 660 aa, Phoma sp.
LYQNGSIIAPCDSPIYCYGDLLREIELAQPFSDSKTFVDLPTIRPLDEVLRAFNNLTKPIQNNTELNNFLTTYFGEAGSELDALPKDQLETQPDFLDNVNSSVIVNFTSQVIDIWPDLTRRYVGAGNCTGCVSSFIPVNRTFVVAGGRFREPYYWDSFWIIEGLLRTKGSFTQIAENIIENFMDLVEELGFVPNGARRYYENRSQPPLLTQMVRVYVEYTQNYTLLERALPVLEQEYEFWVNNRSVTLERGGKNYTLHHYNVSNTQPRPESYREDYITANNLTYYNENGEQFNASHPLNDTQKALLYAELASGAETGWDYSSRWLANPSDAVNDDFFPLRSLNVINTIPVDLNSILYYNEITIAEFHRREGNYCAARQWAELARNRSEAMTALLWNAEYYSYFDYNLTSSAQNIYTLADNTSTPLSLAGAPAGYQVGFQLSQLYPFWTGAAPDSIKGDPTAIRRAFARVEEALDTEAGAVSATNLFTGQQWDEPNVWPPLQYIAIQGLLNTPLEVSEDDDEQTAEDYVWTQNLALRLAQRYTDSLFCTWRSTGGATEEEPQLPGATGNGTIFEKYSDEAINARGGGGEYTVVEGFGWSNGVLIWAVDNFGQKLTTPDCGNITAAAPPSTASKRKRSAVEIHQRDAAWIKGTKENKMFGKK

SEQ ID NO: 208 - protein, 737 aa, Lentinus similis
LPQAVTPSSTSVSSQTVSTAVPSPTASLTSTLPSQIPLPPKQDWCPSEIFCAGELLQTVNVAQLYPDPKTFVDKPTARKSQQVVSNFQNIGGNSSNVTVGAIEDFVNSNFKGEGLELEPIAFANFNPTPAFLNNVSDPLVKAWSQIVHGYWTQLTRSTNDSALCPEGTESGSCESSLIPLNHTFVVPGGRFREQYYWDSYWIVQGLLVSELYDIVNDTLQNFMDELEHIGFIPNGGRIYYLNRSQPPLFIHMLTSYVQASGDTSILKRALPLAEKELAWWSANRSVQVKSPYTNATHNVYRYHVTNTAPRPESYYTDYITANDPTLQTPLTEQQRADLYAELATGAESGWDYSSRWLKEPLAGGSNNTSPALRSLNIRSLVPVDLNSILYKAHLNLAALYNNESHSAAASNHTQAAIALREAILDLHWDANKRAFYDFNITSNARNDIFSAATFYPLWSGIIPDEILSDGSGATAFGAFAAVNMVLNRYNGTFPVTFLETGLQWDAPNAWPPHQFIIIEALRNLPSNITNTPLPSAPSGNSTYALIPAGQVGIAEGDLPGQILSPGQNATKTGPAADINTLNGTVVNGGNATSGEGWAAVLQRELANRYIASALCSWHATGGEVPNLLPRLSDSQLQITQSQNNTGNMFEKFSINDIDSAGRGGEYTVQAGFGWTNGVVLYLTHVFGDKLVAPSCPNLVALSSNTATTSGAVAQMTLPSSLAVTVGAVVLGFVGLVL

SEQ ID NO: 209 - protein, 683 aa, Diaporthe nobilis
QTLDGIYYDGDNIAPCSSALYCYGDILDSIQRAKPFADSKTFVDMPTRVPLEEVRAAYDQLTKPLQNNTELLDFLSNNFGPAGQEVVPVDPGSLGVNASFLGGIANAVNREFTEAVIDLWPNLTRWVNESAVCAECDNSLLSIKRPFIVAGGRFREPYYWDSYWILHGLLRSGGNFTRIARNQIENFLDFVEDYGFVPNGARVYYLNRSQPPLLAQMVRIYIEQTGDATILDRAIPLLIREHDFFMSNRTVHVSVGSRNYTLNRYNVANTEPRPESYYEDYTQVNNASYYANDGRVFPTRNTTQAEKDLQYKNLASGAESGWDFSTRFMRDPTIAANDTYFPLASYNIINIIPVELNSILYWNEVTIAAFLRQQQQQVPNATAEADADAWDARAASRSEAMYSVMWNETLGGYFDFNLTSGSQDVFWARDADSLPTEQAGTEPGQQVVFNIGQLSPFWTGAAPRSLAGDPAAVRRAFSRVDEYLGSRKGGIAPTNFVSGQQWDQPSVWPPHMHILMEALLRTAEAGGESEGGSEDWAWAQDLALRLGQRYFDSAYCTWRATGGGTPSSPPLANPPQDLGGQMFEKYSDQSLNEAGSGGEYVVVVGFGWSNGVLIWVADTFRDRLQTPACGDLTTRGEAGKMREKRMSENGRHGDGSNAISAVKLDYFDAAWTSENVGGLHGVR

SEQ ID NO: 210 - protein, 763 aa, Solicoccozyma terricola
QGNSSMSASNATSSSTGTGTSSSAAAVMTAVPMPTAPLSSPVEMLPLPPVQPWCNGGENATYCPGSLMQLVQLSGIYNDSKTFPDKPTQYNASVTYQAFDALPVNATVGDVETFVEKYFKGEGQELETVQIQNFTQNPTFLNVIDDELYKGFVSTVNGYWSLLVRQTNESALCTNGACESSLIPLNRSFIVPGGRYREIYYWDSFWILEGLLKSELYLYAYNLLENFMDLIEKFGFLPNGGRSYYLNRSQPPVFVQMLNAYIQVTGNVSILTRALPIAETELQWWRTNRTISVTSPYTGTNYSVARYFVTNSAPRPEGYVEDITTAFGGNPALNESARSALYAELASGAETGWDYSSRWCKQPLLNLTDNDPALRTLNVRQQIPVDLNSLLCGDHVLLANLYEFYMNSTIGGGSGISSGGGNSTIGMGAWANSTSGSNMTSNSTSSSNMTGLVQSHRMIAKEFEAAINDLMWDKQKLWWYDFNMTANARADVYHPGGLFPLWQNITPSDIVGNDTAAFGVFAGVRYMVGMYPGPPAPASLIQTGLNWDAPNVWPPHVYTGIKALETVLRINPNSSVVPNITLTDFTRIPTGQLGLNQSQLPPQPASALGNGTADLDQAIAQMQKGKPWPTALAIEFANRYLQSAFCSWYSTGGSIPGLLQQLSPQELNLTGSLTTGSQAMGNIFEKFNLTNVDAAGGGGEYTVQIGFGWSNGVILHTAGEYGQYLVQPSCPLIAIHETANATSTNATKSNNTMVFSGYRLPHD

SEQ ID NO: 211 - protein, 734 aa, Dioszegia cryoxerica
QSSSSSSFSPTPVTTAVPSATAALNQTVSGQGVYPPLQPWCNAGENATYCPGVILQDVQLSGLFPDSKTFVDKPTNGTQNATQQAFQQLGNNITLGQLAQFVNTSFRGEGLELSQVPINGFVANPAAVNKVSNPLYRGWVSTVNSYWSLLIRETNQSAVCTTQCESSLIPLNYTIVVPGGRYREIYYWDTFWILEGLLKSELYTYAWDVLQNFMDFVDVYGFIPNGGRKYYLNRSQPPVFIQMLDAYVKATGNVTILERALPLASEEMRWWINNRTTQVTSPFTGITRRVYVFNVTNSAPRPEGYVEDYEAAFGAQPPLTEAQRGALYAELATGAESGWDYSSRWCKQPVINVTDNLPALRTLNGRSIVPVDLNSLQAGNHALLARLYEVYINASTTSNTTAAQTIRANATQEIALHKTLANDYSQAVLDLHWDPARAWFYDFNLTSNSRESLYTPAGTFALWQNITPPGLEGNDTAALRIASGARYLLGRYGGIQGVSSLLVTGLNWDFPNSWPPHTYTSIKAFQTLGRLVGNASIVGNATIPFSQVATNQLGLNETQLPPQDPALQGNASLTVPSARNVSWPLALEIEYASRYMQGAFCSWYSTGGSISGLLTQLPVSQLNATGTYQAGQTGQMFEKFNATDIDAAGGGGEYTVQIGFGWTNGVVLWLADNFGQYLPQPTCPLVVLSLTNLNSTTAGNSTNGTSPAAPGNATSLVAVSELQGIWEGQRVSRD

SEQ ID NO: 212 - protein, 1020 aa, Talaromyces funiculosus
LPFNERVDQVLRSYEVTSKLDSRSTKPSKHGHTYQTQFLGVTWDQRNWRLQSTVLDQGHYESRGSIANGYIGLNVAGAGPLFELDSPVDGDVINGWPLFSRRQTFAGLAGFYDLQPRTNGTNFPWLSQYGDDSAISGVPHWGGMVLDLGDGEYLDATVDNSTISDYTTTYDYKAGVLSWDYKWTPKNANGSFGISYKIFANKLDVNQAVVQLSITPSTNGSASVVNVIDGYAAVRTDFVSSGNESDVVYTAVKPNGVTNVTAWIYTALDGDDAFDISSAALVNDKPYVHQNDSSIAQSVNVTFTAGTTITINKFVGAASTDAFPDPQSTAREAALSARRRGFDDLFRSHISEWAQVMPDDSVDDFTLANGTLPNDTFIIESAVMAVVNPYYLLQNTVGPNALRRVNNAPVNDWSIPVGGLTSDSYAGQIFWDADVWMQPGLVAAFPESAKRITNYRAAKYSQALENAKTAYTSSQNQTWFSPDAAIYSWTSGRVGNCTATGPCWDYEYHLNGDIGISLVNEWVVSGDNETFKNKHFPIYNSIATLYGDLLKKNGSYYTLTNMTDPDEYANNVDAGGYTMTLISQTLSNANAFRKQFGMNENTTWTEMADNILLIRENDVTLEYTTMNNSVAVKQADVILSTFPLDYTKNYTTSAALNDLDYYALKQSPDGPGMTYAIFSIVANDVSPSGCSAYTYAQYSYDPYIRGPFFQFSEQLLDDYTINGGTHPAFPFLTGHGGANQVVLYGYLGLRLLPDDMLHIDPNLPPQIPSIKYRTFYWRGWPIQAASNYTHTTIQRATTVAPLSTADPTYANKSIHVSVGHNTVNSTTYSLSANGSALVVPNRQIGSINTVAGNVVQCKSVLSTDAYQKGQYPISAVDGAASTKWQPEFAANISSLTVDLTGSNVSSVSGFYFDWAQAPPTNITVLLHNSSSAALASSGDKPGSSAVTLNITISNPYNASTYNANIIALPSSNSTNYTFPAPVPKPRYATLFVQGNQALDETDTKSGNGTGATVAEWAILS

SEQ ID NO: 213 - protein, 1063 aa, Hamigera avellanea
ASPKSRINQCLKKHAGQGSHDDETSSNVYQTRFPGVTWDEDNWSLTTSVLDQGHYQSRGSVANGYLGINVASVGPFFELDIPLNGDVINGWPLYSRRQTFATISGFFDSQPETNGTNFGWLNQYGGESVISGVPHWSGLILDLGDGTYLDSTVDNATLSGFTSSYDFKAGVLSWSYQWTPEGKHGSYDITYRLFTNKLYVNQAVVDMEIVPTVAGKASVVNVIEGSSAVRTDFVESGEDDGAIFSAVRPWGISNVTAYFYANLTVSDNVDLSSRTLVSNKPYVSTNESSIAQSVDVQFIPGKSVRITKFVGAASTDAFANPQETAKRAASTAQTNGYLKSLNSHIAEWASVMPDDSVEDFSLPETGKLPADEHIIESAIISVTNTYYLLQNTVGKNAIKASSDAALNMDSISVGGLTSDSYAGLIFWDADIWMQPGLVASHPEAAEVFTNYRVAKYPQAVKNIETAFASSKNQTNFSPSAAAYPWTSGRYGNCTGTGPCFDYQYHLNGDIGLSMINQWVVSGDTQTFREKHFPIYDSAATFFSNLVERNGSTWTLTNMTDPDEYANHIDAGGYTMPLIAETLLYANSFRKQFGVEPNETWNEIAENVLVLRTNGVTLEFTSMNGSAPVKQADVVLVTYPLDYNNNYSPEDSLNDLDYYANKQSEDGPAMTWAIFSVVANEASPSGCSAYTYAQYAYYPYARAPFFQLSEQMIDDASINGGTHPAYPFLTGHGGANQVNLMGYLGLRLLPDNVIHVDPNLPPQIPHLKYRTFYWRGWPMSAASNYTHTTIQRAVNVPALSTADQKFANVSIPVHVGPETNATVYRLPVNGTLTIPNRQIASKNTVAGNLIQCRPVESQNDFQPGQFPISVVDGASSTRWQPKHADNVSAVTVTFADEEVGSLVSGFYFDWAQAPPVDAAVIFHNSSLENPASAFSFASNSSSSEYSVITTLKNVEQSDPYDPESDKLDIIAIPTGNTTKVTLPSAVPAARYATLFITGNQALGPEDIAAKNGTGATVAEWAIVGQTSSATSKRSIQTRKLQVRSGAALSGLGFAQRRRQSAEMY

SEQ ID NO: 214 - protein, 1020 aa, Talaromyces ruber
LPFNERVDHVLRSHDLTSRLHSRSAKPSNHGGTYQTQFTGVTWDQRNWRLQSNVLDQGHYESRGSIANGYIGLNVAGAGPFFELDTAVDGDVINGWPLFSRRQTFAGLAGFYDLQPTTNGSNFPWLDQYGDDSVISGVPHWGGLVLDLGNGEYLDATVDNSTISDYSTTYDYKAGVLSWHYKWTPKNANGSFEIKYKIFANKLDVNQAVVQLSITPSANGSASVANVIDGYSAVRTEFVASGNESDAIFTAVKPVGVSNVTAWIYAALDGDDAFDFSSATLVNDKPYVHQNDSSIAQSVNVTFTAGTTITINKFVGAASTDAFPDPQSTAREAALKARRRGFDDLFRSHISEWAQVMPDDSVDDFTLANGTLPNDPFIIESAVMAVVNPYYLLQNTVGPNALRRVNNAPVNDWSIPVGGLTSDSYAGQVFWDADVWMQPGLVAAFPESAKRITNYRTAIYSQALENAKTAYTSSQNQTSFSSDAAIYSWTSGRYGNCTATGPCWDYEYHLNGDIGISLVNQWVVSGDNDTFKNTHFPIYNSIATLYGDLLKKNGSYYTLTNMTDPDEYANNVDAGGYTMTLISQTLSNANAFRKQFGMDENTTWTDMADNVLLIRENDVTLEYTTMNNSVAVKQADVILSTYPLDYTKNYTTSAALNDLDYYALKQSPDGPGMTYAIFSIVANDVSPSGCSAYTYAQYSYDPYIRGPFFQFSEQLLDDYTANGGTHPAFPFLTGHGGANQVVLYGYLGLRLLPDNVLHIDPNLPPQIPSVKYRTFYWRGWPIQAASNYTHTTIQRATSVAPLSTADQTYANRSISVQVGQNTVNSTTYSLPANGSAIVVPNRQIGSINTVAGNIAQCKSVLSTDAYQPGQYPISAVDGAASTKWQPEFAANISSLTVDLTSSNASTVSGFYFDWAQAPPTNITVLLHNSSNAPLTSSNSNGGNSTVSLNVTISNPYDASAYNANVITLSSSNTTNYTFPAPVSKPRYATLFVQGNQALDETDLKAGNGTGATVAEWAVLS

SEQ ID NO: 215 - protein, 1055 aa, Trichoderma lixii
ATSNNRVSECLGRNGGSSTGVHFSKNVYKTDFAGVTWDEDNWLLSTTELKQGAFESRGSIANGYLGINVASVGPFFELDTEENGDVISGWPLFSRRQSFATIAGFWDSQPVMNGTNFPWISQYGSDTAISGIPHWSGLILDLGGNTYLDATVDNRTISNFRSTYDYKAGVLSWSYKWTPKGNKGSFDISYRIFANKLYVNQAVVDLQVTASKNVEASIVNVIDGFAAVRTDFVESGEDGNAIFSAVRPNGVANVTAYVYADITGSGGVDLSSRKIVHNKPYVHANASSIAQAVPVKFSAGRAVRVTKFVGGASSDAFKNPKQIAKSAAATALKNGYSKSLNSHVTEWAAVMPESSVDSFADPKTGKLPNDNYIIDSAIIAVVNTYYLLQNTVGKNGSKAANGAPVNVDSISVGGLTSDSYAGQVFWDADLWMQPGLLAAHPEAAERIINYRLARYGQAKENVKTSYAGSQNETFFSASAAVFPWTSGRYGNCTATGPCWDYEYHLNGDIGLALVNQWVVNGDTKDFEKNLFPVYDSIAQLYGNLLKPNGTAWTLTNMTDPDEYANHVDAGGYTMPFIAETLQNANTFRKQFGIEQNKTWNDMASNALVLRENGVTLEFTTMNGSAVVKQADVIMVTFPLSYTTNYTTEDALNDLDYYANKQSPDGPAMTYAFFSIVANEISPSGCSAYTYAQYAFKPYVRAPFYQLSEQIIDDSSINGGTHPAYPFLTGHGGANQVVLFGYLGLRLVPDDFIHIEPNLPPQIPYLRYRTFYWRGWPISAWSNYTHTTISRASGVAALDGADQRFAGKTITIHSGPEESPKAYHLPVKGSVVVPNKQIGSQQTYAGNLVQCHAASSPSDYVPGQFPIAAVDGATSTKWQPASADKLSSITVSLDQEDVGSLVSGFHFDWAQAPPVNATIIFHNEAINDPATVLKSQKHNSNYKVVSSLTNIKQSNPYIKTTDLDIIAIPIGNTTNVTLSQPVAASRYASLVIVGNQGLDHADVVGKNGTGATVAEWAIIGHSKGHTGAPGHHGKRKLNLRAAAAMSDPDSFARRRQ

SEQ ID NO: 216 - protein, 1056 aa, Aspergillus cervinus
STFSHKNDRILKGLKRHGDHYSRKSNTNSTDVYQTKFDGVTWDDDNWLLTTTALDQGDFRSRGSIANGYLGINVASVGPFFELDTAENGDVISGWPLFSRRQTFATIAGFFDSQPTTNGSNFPWLYQYGGDSVISGVPHWSGLVLDLGNDTYLDSTVDNQTIENFTSMYDYKSGVLSWSYTWVPAGNKGSFDIVYRLFAHKLNVNQAVVDMEITPSLSFNATVVNILDGYSAVRTDFVESGNDNGAIFTAVRPWGISNVTAYVYANLTGTPNVDLSSRTIVANKPYVHTNASSIAQAVNVSCSPNETVRITKFVGAASSDAFENPQETARQAVSAAIGAGYLRSLGTHIAEWASIFPDDSVDRFTDPATGKLPANKHIINSAIIAVTNTYYLLQNTVGKNAIQAVSGAPVNIDSISVGGLTSDSYAGQVFWDADVWMQPGLAASHPEAAQRITNFRAAKYPQALANIETAFTSSKNQTSFSPSAAAFPWTSGRFGNCTATGPCWDYEYHLNGDIGLSLMYQWIASGDTQTFRETHFPIYDSIATMYSNIVERNGSYWTLKNMTDPDEYANQIDAGGFTMPLISQTLNYANAFRQQFGLDVNQTWSEIANNVLVLNDNGVTLEYTTMNGSTVVKQADVVLDTYPLVYSNNYTSQNSLDDLDYYANQQSPDGPAMTWAIFSIVANDVSPSGCSAFTYHQYSYDPYARAPFFQLSEQLIDDASTNGGTHPAFPFLTGHGGANQVVIFGYLGLRLLPDEAIHIDPNLPPQIPHVAYRTFYWRGWPISAQSNSTHTTISRAMNASPLDTADSRFANVSIPIYVGTESNATVFQLPPTGPLTILNRQNGFNNTIPGNVAQCRPVYSPDDYAPGQFPIAAVDGATSTRWQPSSANTSSVTVTLPDTQINSPVSGFYFNWWQLPPVNATVIFHDDLLENPAATISSSGNSSSYRVVMTLTNIQQSSPYNAQIAALDEITIPTGNTTTVQLTNHAQTSRYATLLISGNQGLGDTQDGVGATVAEWVILGQGQGSSSSNSNGKRKLGARSAAALSNGWTERRRRLI

SEQ ID NO: 217 - protein, 1053 aa, Rasamsonia brevistipitata
LRSEARVAQVVRAYSSSTGVEAGHGNATQYETRFPGVTWDQRHWRLKSTVLDQGHFQSRGSIANGYVGINVASAGPFFELDTPVDGDVINGWPLFSRRQTFATIAGFYDEQPRTNGSNFDWLYQDGGESVISGVPHWSGLILDLGDGTYLDATVDDSTISDYSTVYDYKAGILSWSYKWTPKSSKGSFKISYRLFAHKLNINQAVVRMEITPSADTDATVVNVLDGYSAVRTDFVGSGKDGDAVYSAVSPWEVQNVTAYVYAVLDGSDGVDLSTLSLVNGKPYVHTNESSIAQSVNVRFRAGKTVTVTKFVGAASTDAFPDPQQTAREAALAAKEEGYDALLRSHVAEWAAVMPEESVDDFTYHNGTLPGDDFIVESAIMAVVNPYYLLQNTVGENALREVSHAPVNEWSISVGGLTSDSYAGLIFWDADLWMHPGLAVAFPQAATRITNYRVAKYEQARQNAKTSFTGSKNQTWFSDSAAVYPWTSGRYGNCTGTGPCWDYEYHLNGDIGLSLINEWVASGDTKTFQESYFPIYDSIATLYADLLQQNGSHWTLTNMTDPDEYANAVDAGGYTMPLIAQTLLYANSFRQQFGAQPNSTWTEMASNILFLRENDITLEYTTMNNSVQVKQADVVLVTYPLEYTTNYNAGNALTDLDYYALKQSPDGPAMTYAIFSIVANEVSPSGCSVYTYAQYSYDPYVRPPFFQLSEQLVDDYTLNGGTHPAYPFLTGHGGANQVVIFGYLGLRLLPDNVIHIDPNLPPQIPQVKYRTFYWRGWPIQAYSNYTHTTIGRAADVLALDTADQRFANTTIPVQVGSGSNATVYQLPIDGVLTVANRQVASTNTVAGNLAQCQPVDSSDSYVPGQYPLAAVDGAASTKWQPSFAANVSSVTVSLPESESGTLVSGFYFDWAQAPPVNATVVFHNNTVENPTRYMSSPTFVTHIDNITLSSPYNAEANPAATILLPSSNTTNVTLAHPMPVPRYATLFITGNQALSESEVQAQNGTGATVAEWAILASNPETGSSKRNLQLRGVGRSALAGLPRRANRKERRTDV

SEQ ID NO: 218 - protein, 1034 aa, Acremonium curvulum
LEERVSQTLNRHGVRSSYNRRADNGDQNRISNTSHPYIYQTSFEGVTWDSRNWRLQGTVLDQGHYQSRGSIANGYFGINVASAGPFFELDTPVDGDVINGWPLFSRRQTFAGLAGFWATQPTTNGTNFPWLYQYGDESPISGIPHWGGLVLDLGDDVYLDATVDNKTIKNYRTTFDYKAGVLTWDYTWSPKKRGSGSFDITYSLFANKLDINQAAVRLSIRPSRDTKAKVVNVLEGYAAVRTDFVDSGKDGDAIYSAVRPVGVNNVTAYVYAVLDADSAVDLSSAKVIDDAPYLYTNKSTIAQSVNVEFKANQNVTITKFVGIASTDAFPKPRDVAKQAAFAGKRRGYDDALRSHVSEWAQVMPDDSVDDFSSDNGTLPDDGFIIESSIMAVVNPFYLLQNTVGANALRRVNNAAVNDYSISVGGLTSDSYAGLVFWDADIWMQPGLAAAFPEAAQRITNYRVALYPQAKRNIKTAFQSSKNKTRFSDDAALYPWTSGRWGNCTASGPCFDYEYHLNGDIGIAFVNEWITSGDEKAFEEKYFPIYDSIATAFANLLQKNGTQWTLTNMTDPDEYANHVDAGGFTMPLISQTLTYANLFRKKFGKEENDTWADMAENVLILRENDVTLEYTAMNNSVEVKQADVVLNTFPLDYTRDYAPSAALNDLDYYALKQSPDGPAMTYAIFSIVANEVSPSGCSAYTYAQYSYSPYLRGPFHQLSEQLTDDFTTNGGTHPAYPFLTGHGGANQVVLFGYLGLRIVPDDKIHVDPNLPPQIPQVKYRTFYWHGWPIAAKSNYTHTTISRATTIKELDTANKKYANASIQVVVGSGKSAKTYKLPANGSSIVVANRKIGTVNTLEGNMIQCQPAQSFDTFVPGQFPISINDGAASTKWQPEFANNISAVTVTVPASKSKKISGFYFDWAQAPPTNATVVLHDEKMDNPTMVLLPVSKDDDKKGSVARVNVTISEPWSAKDKSNFVIGLQGGNTTNFTFSEPVAAKRYATLFIQGNQALDKVDIKYKNGTGATVAEWGILSDDA

SEQ ID NO: 219 - protein, 1015 aa, Talaromyces piceae
ARVDQVLQARDTHHPSLHSSSSYQTRFDGVTWDQRNWRLQSRVLDQGHYQSRGSVANGYLGINVASAGPFFELDTPVDGDVINGWPLFSRRQTFAGLAGFYDRQPTTNSTNYGWLNQYGDESVISGIPHWSGLVLDLGDGHYLDATVDSSTISDYTTTYDFKAGVLSWDYNWAPRQHGGGNSSFHISYQLFAHKLDINQAVVKLSITPSASGNASVVNVIDGYSAVRTEFVKSGTDGDAVYSAVSPVGVSNVTAWVYTVLDGDEAFNLSSAQLVTGKPYVYQNDSSIAQSVNVEFRAGETVTITKFVGAASTDAFADPRQTARDAALLAKKKGFDDLLRSHVSEWAQVMPDGSVDDFTREDGTLPDDEFIIESAVTAVVNPFYLLQNTVGKNALQRVSNAPVNDWSIPVGGLSSDSYAGLIFWDADVWMQPGLVAAFPESAQRITNYRAAMYRQARANIQSAFASSQNKTVFSPDGAIYPWTSGRYGNCTGTGPCFDYEYHLNGDIAISLVNQWVVSGDTETFKNEHFPIYDSIATMYADVLKKNGSFYTLTNMTDPDEYANNKDAGGFTMPLIAKTLLNANDFRKQFNMEENSTWNEKAASVQILRENDVTLEYTTMNNSVAVKQADVVLMTFPLDYTANYSSSSALNDLDYYALKQSPDGPGMTYAIFSIVANQVSPSGCSAYTYAQYSYYPYARAPFFQLSEQLLDDYTANGGTHPAYPFLTGHGGANQVVLYGYLGLRLVPDETLYIDPNLPPQIPQVKYRTFYWRGWPIQAASNYTHTTIRRATTVAPLDTADEKYTDEAITLHVGQQSDGNKYQLPADGTPVTVANRRVSSVNTVKGNMIQCQPVQSTASIQPGQFPIAAVDGAASTKWQPEFAANASSLTVEIPSSGKKRKTVSGFFFDWAEAPPTNATVVLHNNPVSEPTLSSFEAGKDGVVLRAFDIEISSPYNASTYADEIIIPQGNSTNYTFSHPVPAPRFATLFVQGNQALDKVDVENKNGTGPMVAEWVILE

SEQ ID NO: 220 - protein, 1022 aa, Penicillium sp.
LPLEERVDRVLRSYSVGSGLEARHSKYTYQTQFDGVTWDQQNWRLESTVLDQGHYSSRGSIANGYIGLNVAGAGPFFELDAPVDGDVINGWPLFSRRQTFAGLSGFYDVQPTTNGSNYPWLDQYGYDSVISGIPHWGGLVLDLGNGDYLDATVDNSTISDYTTTFDYKAGVLSWDYNWTPKNTSFGISYKIFSSKLDINQAVVQLSITPSANGTASVANVIDGYAAVRTEFVTSGNDSDALFTAVKPTGINNVTAWIYAVLDGDDAFDFSSATLVNNKPYINQNDSSIAQAVDVEFTADSTVTITKFVGAASTDAFADPQKTAKDAALAARIKGFEDLLRSHVSEWAQVMPDDSVDDFSLADGTLPDDIFIIESSVMAVVNPYYLLQNTVGENALRRVNDAPVNIWSIPVGGLTSDSYAGQIFWDADLWMQPGLVAAFPESAKRISNYRVAKYPEALANTNTSFAGSQNHTTFSSDAAIYSWTSGRYGNCTATGPCWDYEYHLNGDIGISLVNQWVTSGDTETFQNDLFPIYNSVATLYADLLKLNGSYYTLTNMTDPDEYANNVDAGGYTMTLISKTLSNANAFRKHFGLDQNSTWTEMAENVLVIRENDVTLEYTTMNNSVAVKQADVVLSTFPLDYTMNYTTSDAVNDLDYYALKQASDGPGMTYAIFSIVADKVSKSGCSAYTYAQYSFDPYIRSPFFQFSEQLDDDYTTNGGTHPAFPFLTGHGGANQVVLYGYLGLRLLPDNVLHIDPNLPPQIPSVKYRTFYWHGWPIQANSNYTHTTIRRATTTAPLSTADQTYSNTSITVQVGTSNGTTYSLRVDGTPLTIKNRRIGSVQTISGNIAQCQPVQSPDSYEPGQYPLSVVDGASSTKWQPESAANISSVTVTLGSSYSPGNSSNATASSILGFYFNWAQAPPDNITVVLHNASIPYLNASLSSLSNTTTTTSLNITVSNPYDSSADEKIIVLPSSNTTNYTFPSPVPVPRFATLFIQGNQGLDQTDLEYGNGTGATVAEWAILSA

SEQ ID NO: 221 - protein, 1020 aa, Talaromyces aurantiacus
LPFQDRVDQVLRSYSAKTLDIRSAKSSSKHGNTYETQFPGVTWDQRNWRLQSTVLDQGHYESRGSIANGYIGLNVAGAGPFFELDTPVDGDVINGWPLFSRRQTFAGLAGFYDLQPTTNGSNFPWLDQYGDDSAISGVPHWGGLVLDLGDGQYLDATVDNSTVSDYKTTYDFKAGVLSWDYKWTPKSSNVSFGISYKVFANKLDVNQAVVQLSITPSANGSASVVNVIDGYSAVRTDFVSSGNESDAIYTAVKPLGVSNVTAWIYATLDGDDAFDFSSATIVNNKPYVHQNDSSIAQSVNVTFTAGTTVTINKFVGAASTDAFPDPRSTAKEAALAGRRRGYDDSFRAHISEWAQVMPDDSVDDFTLANGTLPNDTFIIESAVMAVVNPYYLLQNTVGPNALRRVNNAPVNDWSISVGGLTSDSYAGQVFWDADVWMQPGLVAAFPESAKRITNYRAAIYSQALANAKTAYTSSQNQTSFSSDAAIYSWTSGRYGNCTATGPCWDYEYHLNGDIGISLVNQWVASGDNETFKNTHFPIYNSIATLYGDLLKKNGSYYTLTNMTDPDEYANNVDAGGYTMTLISQTLSNANAFRKQFGMDENTTWTEMADNVLLIRENDITLEYTTMNNSVAVKQADVILSTYPLDYTKNYTTSAALNDLDYYALKQSPDGPGMTYAIFSIVANDVSPSGCSAYTYAQYSYDPYIRGPFFQFSEQLLDDYTANGGTHPAFPFLTGHGGANQVVLYGYLGLRLVPDDKLHIDPNLPPQIPSVKYRTFYWRGWPIQAASNYTHTTIQRATRVAPLSTADMTYANKSISVQVGQNTANSTTYSLPVNGSALVISNRQIGSINTVQGNIAQCKSVQSMNGYQPGQYPISAVDGAASTKWQPEFAANVSSLTVDLTSSNASSVSGFYFDWAQAPPVNVTVVLHNSTSASLTSSAAQNGSSTVSLNITISNPYNASSYDANVIELSSSNTTNYRFPAPVPKPRYATLFVQGSQALDETDMKAGNGTGATVAEWAILS

SEQ ID NO: 222 - protein, 1016 aa, Talaromyces pinophilus
LPFNERVDQVLRSYSPKNLESRSTKHGNSYQTQFSGVTWDQRNWRLQSTVLDQGHYESRGSIANGYIGLNVAGAGPFFELDTAVDGDVINGWPLFSRRQTFAGLAGFYDLQPTTNGSNFPWLSQYGDDSAISGVPHWGGLILDLGDGEYLDATVDNSTISDYTTTYDYKAGVLSWDYKWTPKNSKASFGINYKIFANKLDVNQAVVQLSITPSANGSGSVVNVIDGYSAVRTDFVSSGNESDVIYTAVKPVGVNNVTAWIYAALDGDEAFDFSSAELVNDKPYVHQNDSSIAQSVNVAFTAGTTITINKFVGAASTDAFPDPQSTAREAAMTARRRGFDDLFRSHVSEWAQVMPDDSVDDFTLANGTLPNDTFIIESAVMAVVNPYYLLQNTVGANALRRVNNAPVNDWSIPVGGLTSDSYAGQIFWDADVWMQPGLVAAFPESAKRITNYRTAKYSQALENAKTAYTSSQNQTSFSSDAAIYSWTSGRYGNCTATGPCWDYEYHLNGDIGISLVNQWVVSGDNETFKNTHFPIYNSIATLYGDLLKKNGSYYTLTNMTDPDEYANNVDAGGYTMTLISQTLSNANAFRKQFGMDENTTWTEMADNILLIRENDVTLEYTTMNNSVAVKQADVILSTFPLDYTKNYTTSAALNDLDYYALKQSPDGPGMTYAIFSIVANDVSPSGCSAYTYAQYSYDPYIRGPFFQFSEQLLDDYTANGGTHPAFPFLTGHGGANQVVLYGYLGLRLLPDDMLHIDPNLPPQIPSVKYRTFYWRGWPIQAASNYTHTTIQRATSVAPLSTADPAYANTSISVSVGQNTANSTTYSLPVNGSAIVVPNRQIGSINTVAGNIAQCVSVLSTDAYQPGQYPISAVDGAASTKWQPEFAANVSSLTVDLTSSNASSVSGFYFDWAQAPPTNITVLLHNSSSAALTSSSTHGGSSSVSLNITISNPYDASSYDANVIALSSSNTTNYTFSAPVAKPRYATLFVQGNQALDETDTKAGNGTGATVAEWAILS

SEQ ID NO: 223 - protein, 1069 aa, Talaromyces leycettanus
TSANARINRCVKKHAGGKTPSGPSNNTYQTRFPGVTWDQDNWCLSTTTLDQGHYESRGSVANGYLGINVASVGPFFEFDTPVDGDVINGWPLFDRRMSFATISGFWDQQPTTNGSNFPWLYQYGGESVISGVPHWSGLILDLGDNTYLDATVDSRTISGFSTTYDFKSGVLSWSYQWTPAGNMGSYNITYRLFAHKLYVNQAVVDMEVVSSTEAKATVVNVIDGASAVRTDFVESGQDDGAIYTAVRPWGIANVTAYIYANITGSDNVDMRSRALVTNKPYVNGNASSITQAVNVHFTPGKSVRITKFVGGASSDAFSNPQQIAKQACSTAQANGYVKSLRSHVAEWASVMPDDSVDDFTFPSNGTLPADEYIIESQIISVANTYYLLQNTVGKNAINASSSTELNKDSIAVGGLTSESYAGMIFWDADVWMQPGLVASHPEAAQRITNYRVAKYPQAKANVATAYQSSKNQTNFSPDAAVYSWTSARYGNCTATGPCWDYEYHLNGDIGLSIINQYVASGDTQTFKEKLFPVFDSVATLYSNIVQKNGSSWTLTNMTDPDEYANQVDAGGYTMPLIAQTLLYANSFRQQFGLETNDTWNEIAQDVLVIRENGVTLEFTTMNGSAVVKQADVVLDTYPLGYTHNYGPTDALNDLDYYANRQSPDGPAMTWAIFSVVANQISPSGCSAYTYAQYAFSPYARAPFYQLSEQLIDDASLNGGTHPAYPFLTGHGGALQVNLFGYLGFRYLPDNVIHIDPNLPPQIPHITYRTFYWRGWPITAASTYTHTTLSRAWNVSSLDSADPKFANASIPVHVGLESNVTVYRLPVNGTLTVPNRMVGSKNTLAGNMVQCRPVQSMDGYQPGQFPISVVDGASSTKWQPLYSANVSSVTVTLSSSAVGKSVNGFYFDWAQNPPVNAAVVFHNSSFAQNPATTFSFDNPSASGNLYSVVSVLKDIQLSDPYDPATTDLDVIAIPKGNTTNVTLSSPVPAARYATLFIQGNQANSPAEVAAKNGTGATVAEWAILGQEVQNNGYGDQIEARRLDVRGAAALSGMGSFTQRRKRKMILPRFD

SEQ ID NO: 224 - protein, 1016 aa, Talaromyces variabilis
ALSPGARVNQVLRAHNSLPPSLTDNSTGSSYKTRFDGVTWDQRNWRLQSRVLDQGHYEARGSVANGYIGINVASAGPFFELDTPVDGDVINGWPLFSRRQTFAGLAGFYDLQPTTNSTNYGWLNQYGDESVISGIPHWAGLVLDLGNGDYLDATVDNSTISDYTTTYDYKAGILSWDYKWTPRQNSSSFRISYQLFANKLDINQAVVKLSITPSKSGNASVVNVIDGYSAVRTDFVKSGSDGNAIYTAVSPVGVSNVTAWVYAVLDGDKAFDLSSPSRVTGKPYIHQNESSIAQAVNVEFSAGKTVTIAKFVGAASTDAFSNPQKKAKTAALDGKKKGFEDLLRSHVSEWAQVMPDDSVDDFTLANGTLPDDSFIIEQAVTAVVNPYYLLQNTVGKNALQRVNNAPVNDWSIPVGGLSSDSYAGMIFWDADVWMQPGLVAAFPESAKRITNYRAAKYQQAIANVKTAYSSSQNETVFSPNAAIFPWTSGRYGNCTGTGPCWDYEYHLNGDIAISLVNQWVVSGDTETFQNEHFPIYNSIATVYGDLLKKNGSYYTLTNMTDPDEYANNKDAGGYTMPLIANTLIKANEFRRQFGMAENATWNEMAENVLIIRENDVTLEYTTMNNSVAVKQADVVLRTFPLDYTTNYSSSAALNDLDYYALKQSPDGPGMTYAIFSIVANEVSPSGCSAYTYAQYSYDPYARAPFFQLSEQLIDDYTTNGGTHPAYPFLTGHGGANQVVLYGYLGLRLVADEILHIDPNLPPQIPQVTYRTFYWRGWPIQAASNYTHTTIHRATTVAPLDSAEKKYAKSAISVQVGQQANSTTYKLPADGTPLTVANRKVGSTNTIKGNIAQCQSVQSVDSYQPGQYALAAVDGAASTKWQPEFAANVSSLTVSIPSGKTSVSGFYFDWAQAPPSNATVVFHNNSVSNPTFSSFGSRKGARITHIDVKLSNPYNASSNADAIVIPSGNTTNFTFSNPVPAPRFATLFVQGNQGLDKVDVQNGNGTGATVAEWAILE

SEQ ID NO: 225 - protein, 1050 aa, Aspergillus niger
LPGKNARISASLKRHAGRDVPQTALNSTNVYQTKFSGVTWDEDHWLLTTTTPDQGHYQSRGSVANGYLGINVANIGPFFELDEPVNGDVINGWPLYSRRQSFATISGFWDRQAHTNGSNFPWLSQYGDDSVISGVPHWSGLILDLGDDTYLDATVDNRTISNFKSTYDFKSGVLSWSYTWTPQGNKGSYAITYRLFAHKLYVNRAVVDMEITPLTNGNATVVNVLDGYAAVRTDFVASGQEEGAIFSAVRPWGVNNVTAYVYATLDGSDSVDLSSRRIVTDKPYVSTNSSSVAQAVDVMFTANETVRITKFVGGATTDYFLATQETAKAACLAGLADGYVKSLQSHVGEWATIMHDHSVDRFTDPATGKLPEDSHIVDSAIIAVTNTYYLLQNTAGTNAIVAAGGIPVNVDSCAPGGLTSDSYGGQIFWDADLWMQPGLVASHPESAQRFTNYRIALHYQAQANIETAFTGSKNQTSFSSSAAIYPWTSGRFGNCTATGPCWDYQYHLNGDIGLAMINQWVASGDTAWFKNYLFPIYDAAATLYSELVERNGSSWTLTNMTDPDEYANSINAGGYTMPLIAETLQNANKLRKQFGLEPNETWDEIAEDVLILRENGVTLEYTSMNGSAVVKQADIVLNTFPLTYESDNYTATNSLTDLDYYANKQSADGPAMTYAIFAIVASDVSPSGCSAFTYHQYSYAPYARGPWYQLSEQMIDDASINGGTHPAFPFLTGHGGANQVALYGYLGLRLHPDDTIYIDPNLPPQIPHITYRTFYWHGWPISAWSNYTHTTIQRDSSLAPLASADLLFSNVSIKVQVGQSTASADEATIYYLPLSGALTVPNRMIGSVNTTPGNQVQCHPVYSPDAYEPGQFPISAVDGATSTKWQPSTSDLTSLTVTLSTTAEAGAEEVSGFYFDWSQAPPENLTVIFHDSPIGNPSTVFAAAGSNSTGYRVITSMSNIVQSKPYNAISAEELNVVSIPTANTTTITLDAPVQKARYATLLIAGNQANETAGATVAEWVILGQNSTSSSSAQAKRKMSARSKATLAQLS

SEQ ID NO: 226 - protein, 1056 aa, Trichoderma reesei
TTLVDRVTKCLSRHDGSDAESHFSKNVYKTDFAGVTWDEDNWLLSTTQLKQGAFEARGSVANGYLGINVASVGPFFEVDTEEDGDVISGWPLFSRRQSFATVAGFWDAQPQMNGTNFPWLSQYGSDTAISGIPHWSGLVLDLGGGTYLDATVSNKTISHFRSTYDYKAGVLSWSYKWTPKGNKGSFDISYRLFANKLHVNQAVVDMQVTASKNVQASIVNVLDGFAAVRTDFVESGEDGSAIFAAVRPNGVANVTAYVYADITGSGGVNLSSRKIVHNKPYVHANASSIAQAVPVKFAAGRTVRVTKFVGAASSDAFKNPKQVAKKAAAAGLSNGYTKSLKAHVEEWATVMPESSVDSFADPKTGKLPADSHIVDSAIIAVTNTYYLLQNTVGKNGIKAVDGAPVNVDSISVGGLTSDSYAGQIFWDADLWMQPGLVAAHPEAAERITNYRLARYGQAKENVKTAYAGSQNETFFSASAAVFPWTSGRYGNCTATGPCWDYEYHLNGDIGISLVNQWVVNGDTKDFEKNLFPVYDSVAQLYGNLLRPNKTSWTLTNMTDPDEYANHVDAGGYTMPLIAETLQKANSFRQQFGIEQNKTWNDMASNVLVLRENGVTLEFTAMNGTAVVKQADVIMLTYPLSYGTNYSAQDALNDLDYYANKQSPDGPAMTYAFFSIVANEISPSGCSAYTYAQNAFKPYVRAPFYQISEQLIDDASVNGGTHPAYPFLTGHGGAHQVVLFGYLGLRLVPDDVIHIEPNLPPQIPYLRYRTFYWRGWPISAWSNYTHTTLSRAAGVAALEGADQRFARKPITIHAGPEQDPTAYRLPVKGSVVIPNKQIGSQQTYAGNLVQCHAASSPNDYVPGQFPIAAVDGATSTKWQPASADKVSSITVSLDKEDVGSLVSGFHFDWAQAPPVNATVIFHDEALADPATALASAHKHNSKYTTVTSLTNIELSDPYVSTKDLNAIAIPIGNTTNVTLSHPVAASRYASLLIVGNQGLDPVDVKAKNGTGATVAEWAIFGHGKEHSGKPSSHSKRRLNVRTAATLSNPRSFMRRRL

SEQ ID NO: 227 - protein, 19 aa, Saccharomyces cerevisiae
MLSLKTLLCTLLTVSSVLA

SEQ ID NO: 228 - DNA, 185 bp, Saccharomyces cerevisiae
agtgcttttaactaagaattattagtcttttctgcttattttttcatcatagtttagaacactttatattaacgaatagtttatgaatctatttaggtttaaaaattgatacagttttataagttactttttcaaagactcgtgctgtctattgcataatgcactggaaggggaaaaaaaaggtg

SEQ ID NO: 229 - protein, 555 aa, Pycnoporus sanguineus glucoamylase
QSSAVDAYVASESPIAKQGVLNNIGPNGSKAHGAKAGIVVASPSTENPDYLYTWTRDSSLVFKLLIDQFTSGDDTSLRGLIDDFTSAEAILQQVSNPSGTVSTGGLGEPKFNIDETAFTGAWGRPQRDGPALRATSIIRYANWLLDNGNTTYVSNTLWPVIQLDLDYVADNWNQSTFDLWEEVDSSSFFTTAVQHRALREGATFASRIGQSSVVSGYTTQADNLLCFLQSYWNPSGGYVTANTGGGRSGKDSNTVLTSIHTFDPAAGCDAATFQPCSDKALSNLKVYVDAFRSIYTINNGIASNAAVATGRYPEDSYMGGNPWYLTTSAVAEQLYDALYVWDQLGGLNVTSTSLAFFQQFASGLSTGTYSASSSTYATLTSAIRSFADGFLAINAKYTPADGGLAEQYSRNDGTPLSAVDLTWSYAAALTAFAAREGKTYGSWGAAGLTVPASCSGGGGATVAVTFNVQATTVFGENIYITGSVAALQNWSPDNALILSAANYPTWSITVNLPANTVVQYKYIRKFNGQVTWESDPNNQITTPSGGSFTQNDVWR

SEQ ID NO: 230 - protein, 599 aa, Trichoderma reesei
SVDDFISTETPIALNNLLCNVGPDGCRAFGTSAGAVIASPSTIDPDYYYMWTRDSALVFKNLIDRFTETYDAGLQRRIEQYITAQVTLQGLSNPSGSLADGSGLGEPKFELTLKPFTGNWGRPQRDGPALRAIALIGYSKWLINNNYQSTVSNVIWPIVRNDLNYVAQYWNQTGFDLWEEVNGSSFFTVANQHRALVEGATLAATLGQSGSAYSSVAPQVLCFLQRFWVSSGGYVDSNINTNEGRTGKDVNSVLTSIHTFDPNLGCDAGTFQPCSDKALSNLKVVVDSFRSIYGVNKGIPAGAAVAIGRYAEDVYYNGNPWYLATFAAAEQLYDAIYVWKKTGSITVTATSLAFFQELVPGVTAGTYSSSSSTFTNIINAVSTYADGFLSEAAKYVPADGSLAEQFDRNSGTPLSAVHLTWSYASFLTAAARRAGIVPPSWANSSASTIPSTCSGASVVGSYSRPTATSFPPSQTPKPGVPSGTPYTPLPCATPTSVAVTFHELVSTQFGHTVKVAGNAAALGNWSTSAAVALDAVNYRDNHPLWIGTVNLEAGDVVEYKYIIVGQDGSVTWESDPNHTYTVPAVACVTQVVKEDTWQS

SEQ ID NO: 231 - protein, 633 aa, Bacillus amyloliquefaciens
GPAAANAETANKSNKVTASSVKNGTILHAWNWSFNTLTQNMKDIRDAGYAAIQTSPINQVKEGNQGDKSMRNWYWLYQPTSYQIGNRYLGTEQEFKDMCAAAEKYGVKVIVDAVINHTTSDYGAISDEIKRIPNWTHGNTQIKNWSDRWDVTQNSLLGLYDWNTQNTEVQVYLKRFLERALNDGADGFRYDAAKHIELPDDGNYGSQFWPNITNTSAEFQYGEILQDSASRDTAYANYMNVTASNYGHSIRSALKNRNLSVSNISHYASDVSADKLVTWVESHDTYANDDEESTWMSDDDIRLGWAVIGSRSGSTPLFFSRPEGGGNGVRFPGKSQIGDRGSALFKDQAITAVNTFHNVMAGQPEELSNPNGNNQVFMNQRGSKGVVLANAGSSSVTINTSAKLPDGRYDNRAGAGSFQVANGKLTGTINARSAAVLYPDDIGNAPHVFLENYQTGAVHSFNDQLTVTLRANAKTTKAVYQINNGQQTAFKDGDRLTIGKGDPIGTTYNIKLTGTNGEGAARTQEYTFVKKDPSQTNIIGYQNPDHWGQVNAYIYKHDGGRAIELTGSWPGKAMTKNANGMYTLTLPENTDTANAKVIFNNGSAQVPGQNQPGFDYVQNGLYNNSGLNGYLPH

SEQ ID NO: 232 - DNA, 700 bp, Saccharomyces cerevisiae
cacccatgaaccacacggttagtccaaaaggggcagttcagattccagatgcgggaattagcttgctgccaccctcacctcactaacgctgcggtgtgcggatacttcatgctatttatagacgcgcgtgtcggaatcagcacgcgcaagaaccaaatgggaaaatcggaatgggtccagaactgctttgagtgctggctattggcgtctgatttccgttttgggaatcctttgccgcgcgcccctctcaaaactccgcacaagtcccagaaagcgggaaagaaataaaacgccaccaaaaaaaaaaaaataaaagccaatcctcgaagcgtgggtggtaggccctggattatcccgtacaagtatttctcaggagtaaaaaaaccgtttgttttggaatttcccatttcgcggccacctacgccgctatctttgcaacaactatctgcgataactcagcaaattttgcatattcgtgttgcagtattgcgataatgggagtcttacttccaacataacggcagaaagaaatgtgagaaaattttgcatcctttgcctccgttcaagtatataaagtcggcatgcttgataatctttctttccatcctacattgttctaattattcttattctcctttattctttcctaacataccaagaaattaatcttctgtcattcgcttaaacactatatcaataa

SEQ ID NO: 233 - DNA, 240 bp, Saccharomyces cerevisiae
tcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcga

SEQ ID NO: 234 - protein, 18 aa, Saccharomyces cerevisiae
MQLLRCFSIFSVIASVLA

SEQ ID NO: 235 - DNA, 47 bp, Artificial Sequence
  ARTIFICIAL DNA PRIMER
atgatgaaaaaataagcagaaaagactaataattcttagttaaaagc

SEQ ID NO: 236 - DNA, 26 bp, Artificial Sequence
  ARTIFICIAL DNA PRIMER
atgctttcgcttaaaacgttactgtg

The invention claimed is:

1. A method of producing a fermentation product from a starch-containing or cellulosic-containing material comprising:
    (a) saccharifying the starch-containing or cellulosic-containing material; and
    (b) fermenting the saccharified material of step (a) with a recombinant yeast cell;
    wherein the recombinant yeast cell comprises a heterologous polynucleotide encoding an alpha-amylase having a mature polypeptide sequence with at least 95% sequence identity to the amino acid sequence of SEQ ID NO: 126.

2. The method of claim 1, wherein the alpha-amylase has a mature polypeptide sequence comprising or consisting of the amino acid sequence of SEQ ID NO: 126.

3. The method of claim 1, wherein saccharification of step (a) occurs on a starch-containing material.

4. The method of claim 3, comprising liquefying the starch-containing material by contacting the material with an alpha-amylase prior to saccharification.

5. The method of claim 4, wherein liquefying the starch-containing material and/or saccharifying the starch-containing material is conducted in presence of exogenously added protease.

6. The method of claim 1, wherein fermentation and saccharification are performed simultaneously in a simultaneous saccharification and fermentation (SSF).

7. The method of claim 1, comprising recovering the fermentation product from the from the fermentation.

8. The method of claim 1, wherein the fermentation product is ethanol.

9. The method of claim 1, wherein the recombinant yeast cell comprises a heterologous polynucleotide encoding a glucoamylase or a protease.

10. The method of claim 1, wherein the recombinant yeast cell is a *Saccharomyces cerevisiae* cell.

11. A recombinant yeast cell comprising a heterologous polynucleotide encoding an alpha-amylase having a mature polypeptide sequence with at least 95% sequence identity to the amino acid sequence of SEQ ID NO: 126.

12. The recombinant yeast cell of claim 11, wherein the alpha-amylase has a mature polypeptide sequence comprising or consisting of the amino acid sequence of SEQ ID NO: 126.

13. The recombinant yeast cell of claim 11, wherein the fermenting organism comprises a heterologous polynucleotide encoding a glucoamylase or a protease.

14. The recombinant yeast of claim 11, wherein the cell is a *Saccharomyces cerevisiae* cell.

15. The recombinant yeast of claim 11, wherein the alpha-amylase has a mature polypeptide sequence with at least 97% sequence identity to the amino acid sequence of SEQ ID NO: 126.

16. The method of claim 1, wherein the alpha-amylase has a mature polypeptide sequence with at least 97% sequence identity to the amino acid sequence of SEQ ID NO: 126.

17. The method of claim 1, wherein the alpha-amylase has a mature polypeptide sequence with at least 98% sequence identity to the amino acid sequence of SEQ ID NO: 126.

18. The method of claim 1, wherein the alpha-amylase has a mature polypeptide sequence with at least 99% sequence identity to the amino acid sequence of SEQ ID NO: 126.

19. The recombinant yeast of claim 11, wherein the alpha-amylase has a mature polypeptide sequence with at least 98% sequence identity to the amino acid sequence of SEQ ID NO: 126.

20. The recombinant yeast of claim 11, wherein the alpha-amylase has a mature polypeptide sequence with at least 99% sequence identity to the amino acid sequence of SEQ ID NO: 126.

* * * * *